United States Patent
Wu et al.

(10) Patent No.: US 8,003,326 B2
(45) Date of Patent: Aug. 23, 2011

(54) METHOD FOR DIAGNOSING AUTISM SPECTRUM DISORDER

(75) Inventors: Bai-Lin Wu, Newton, MA (US); Yiping Shen, Lexington, MA (US); David T. Miller, Westwood, MA (US); Orah S. Platt, Brookline, MA (US)

(73) Assignee: Children's Medical Center Corporation, Boston, MA (US)

( * ) Notice: Subject to any disclaimer, the term of this patent is extended or adjusted under 35 U.S.C. 154(b) by 0 days.

(21) Appl. No.: 12/347,411

(22) Filed: Dec. 31, 2008

(65) Prior Publication Data

US 2009/0203014 A1  Aug. 13, 2009

Related U.S. Application Data

(63) Continuation-in-part of application No. 12/239,386, filed on Sep. 26, 2008.

(60) Provisional application No. 61/018,556, filed on Jan. 2, 2008.

(51) Int. Cl.
*C12Q 1/68* (2006.01)
*C12P 19/34* (2006.01)
*C07H 21/02* (2006.01)
*C07H 21/04* (2006.01)

(52) U.S. Cl. .......... 435/6; 435/91.2; 536/23.1; 536/24.3

(58) Field of Classification Search .................. None
See application file for complete search history.

(56) References Cited

U.S. PATENT DOCUMENTS

| | | | | |
|---|---|---|---|---|
| 6,955,901 | B2 * | 10/2005 | Schouten | 435/91.1 |
| 2003/0082618 | A1 * | 5/2003 | Li et al. | 435/6 |
| 2009/0176226 | A1 * | 7/2009 | Wu et al. | 435/6 |

OTHER PUBLICATIONS

Fernandez, B.A. et al. JMG Online First (Sep. 24, 2009) printed from jmg.bmj.com, pp. 1-24.*
Hacker, U.T. et al. Gut (1997) vol. 40 No. 5, pp. 623-627.*
Miyake N. et al. American Journal of Medical Genetics (2006) 140A:205-211.*
Ballif, B.C. et al., Nature Genetics, 39(9):1071-1073 (2007). "Discovery of a previously unrecognized microdeletion syndrome of 16p11.2-p12.2."
Kumar, R.A. et al., HMG Advance Access, 2007. "Recurrent 16p11.2 microdeletions in autism."
Finelli, P. et al., J Med Genet, 41:e90 (2004). "FISH characterisation of an identical (16)(p11.2p 12.2) tandem duplication in two unrelated patients with autistic behaviour."
Ghebranious, N. et al., American Journal of Medical Genetics Part A, 143A:1462-1471 (2007). "A novel microdeletion at 16p11.2 harbors candidate genes for aortic valve development, seizure disorder, and mild mental retardation."
Sebat, J. et al., Science, 316:445-449 (2007). "Strong association of de novo number mutations with autism."
Shen, Y. et al., Clinical Chemistry, 53:12 (2007). "Development of a focused oligonucleotide-array comparative genomic hybridization chip for clinical diagnosis of genomic imbalance."
Weiss, L.A. et al., The New England Journal of Medicine, 358(7):667-675 (2008). "Association between microdeletion and microduplication at 16p11.2 and autism."

* cited by examiner

*Primary Examiner* — Stephen Kapushoc
(74) *Attorney, Agent, or Firm* — Nixon Peabody LLP

(57) ABSTRACT

The present invention provides methods of diagnosing and/or predicting autism spectrum disorder comprising determining the presence of microdeletions and microduplications on chromosomes 15 and 16.

7 Claims, 10 Drawing Sheets

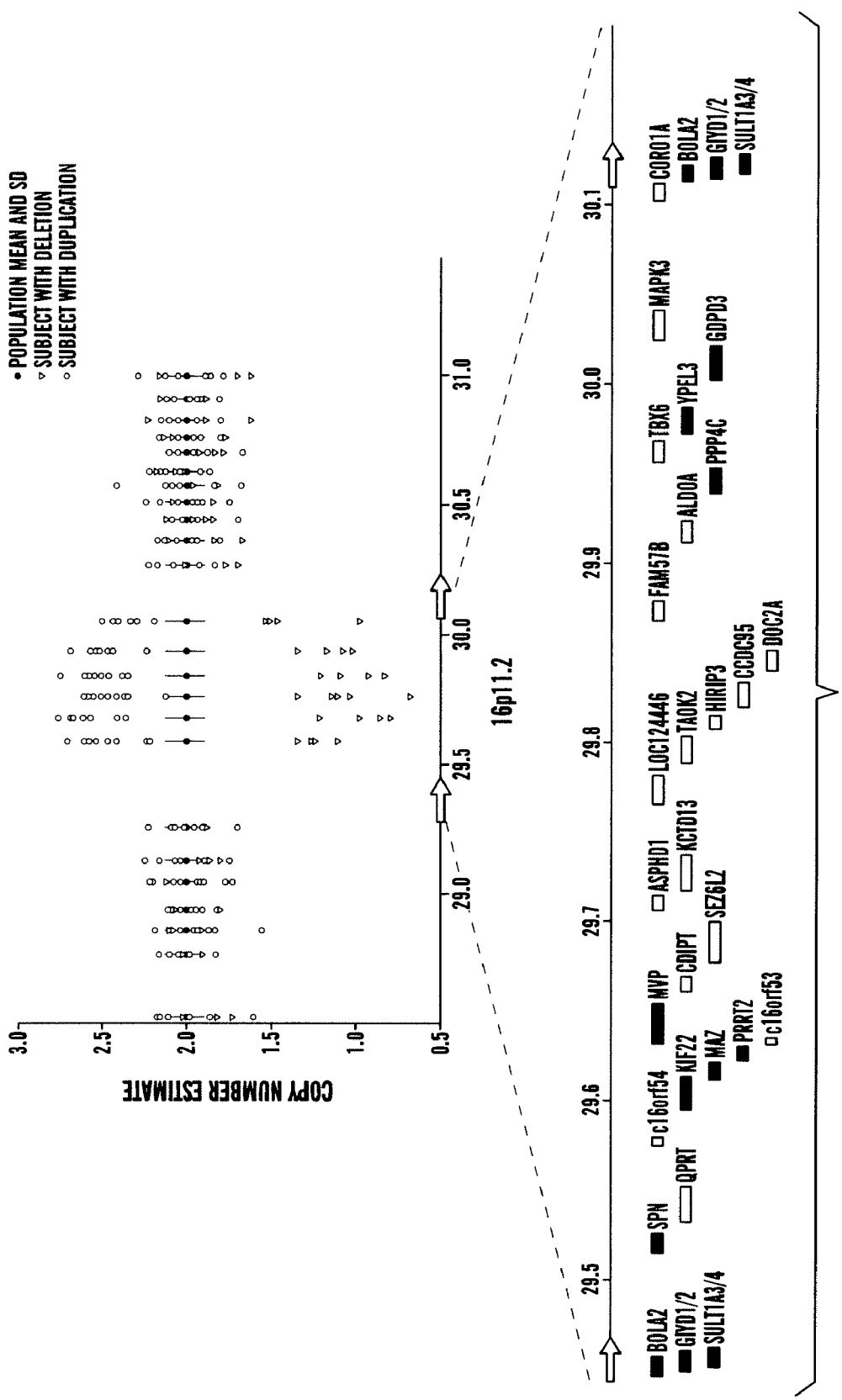

US 8,003,326 B2

METHOD FOR DIAGNOSING AUTISM SPECTRUM DISORDER

CROSS REFERENCE TO RELATED APPLICATIONS

This application is a continuation-in-part of patent application Ser. No. 12/239,386, filed on Sep. 26, 2008, which claims the benefit under 35 U.S.C. §119(e) of the U.S. Provisional application No. 61/018,556 filed Jan. 2, 2008, the contents of which are incorporated herein by reference in its entirety.

BACKGROUND OF INVENTION

Autism spectrum disorder (ASD) is a pervasive developmental disorder that causes severe and pervasive impairment in thinking, feeling, language, and the ability to relate to others. Individuals affected with ASD do not necessary exhibit signs of mental retardation. The onset is generally before the age of 3 years, and is usually first diagnosed in early childhood. ASD can range from a severe form, called autistic disorder, through pervasive development disorder not otherwise specified (PDD-NOS), to a much milder form, Asperger syndrome. ASD also includes two rare disorders, Rett syndrome and childhood disintegrative disorder. ASD has a prevalence of 0.6% in the population, affecting many more boys than girls.

Currently there is no single best treatment for all children with ASD nor is there a simple diagnosis method for the disorder. One point that expert professionals agree on is that early intervention is important; another is that most individuals with ASD respond well to highly structured, specialized programs. As soon as a child's disability has been identified, it is recommended that the intervention programs should be started. Effective programs teach early communication and social interaction skills. In children younger than 3 years, appropriate interventions usually take place at home or at a child care center. These early intervention programs typically target specific deficits in learning, language, imitation, attention, motivation, compliance, and initiative of interaction. Included are behavioral methods, communication, occupational and physical therapy along with social play interventions.

Although early intervention has been shown to have a dramatic impact on reducing symptoms and increasing a child's ability to grow and learn new skills, it is estimated that only 50 percent of children are diagnosed before kindergarten. Currently there is no method of early diagnosis and/or predictive method for autism. Parents are usually the first to notice unusual behaviors in their child. In some cases, the baby seemed "different" from birth, unresponsive to people or focusing intently on one item for long periods of time. The first signs of an autism spectrum disorder can also appear in children who had been developing normally. When an affectionate, babbling toddler suddenly becomes silent, withdrawn, self-abusive, or indifferent to social overtures, something is wrong.

Twin and family studies have estimated the heritability of autism as being up to 90%, making it one of the most heritable complex disorders. Rare genetic syndromes and known chromosomal anomalies explain roughly 10% of cases of autism, including Fragile X, tuberous sclerosis, Smith-Lemli-Opitz syndrome, and maternally-inherited duplications of the Prader-Willi/Angelman syndrome region (15q11-13). However, despite high heritability, genetic studies to date have not provided substantial insight into the 90% of autism with idiopathic etiology.

Therefore, there is a need for an early diagnosis method and also methods of predicting whether a fetus, an infant or an individual is at risk of developing autism.

SUMMARY OF THE INVENTION

Embodiments of the invention are based on the discovery that there are certain genomic imbalances that are associated with autism spectrum disorder (ASD). The inventors have identified regions of rare copy-number variation in families with autism and observed an association between a microdeletion on chromosome 16 (and the inherited reciprocal duplication) (on locus 16p11.2) and autism and ASD. Without wishing to be bound by a theory, both the deletion (about 546-593 kb, in the 29.5 Mb-31.1 Mb region) and the duplication are likely to be mediated by the 147-kb segmental duplication flanking the deleted sequence or reciprocal duplication. In addition, microdeletions and/or microduplications were observed on chromosome 15 (locus 15q13.2q13.3, BP4-BP5) that are associated with individuals affected with autism and ASD. The microdeletions and/or microduplications on chromosome 15 (locus 15q13.2q13.3, BP4-BP5) range from about 0.5 Mb to about 2.0 Mb in size.

Accordingly, in one embodiment, provided herein is a method for diagnosing ASD and/or autism in an individual, the method comprising the steps of: (a) detecting a microdeletion on chromosome 16p11.2; and (b) detecting a segmental duplication on chromosome 16p11.2; wherein the presence of a about 500 kb microdeletion that is flanked by a about 100 kb segmental duplication on chromosome 16p11.2 in the genome of the individual is indicative that the individual is likely affected with ASD and/or autistic. In one embodiment, the microdeletion and segmental duplication on chromosome 16p11.2 occurs between 29.5 Mb-31.1 Mb region.

In some embodiments, the microdeletion on chromosome 16p11.2 is between 500-600 kb. In one embodiment, the microdeletion on chromosome 16p11.2 is 546 kb. In another embodiment, the microdeletion on chromosome 16p11.2 is 593 kb. In some embodiments, the microdeletion on chromosome 16p11.2 involves the deletion of any of the genes selected from the group consisting of: BOLA2, GIYD1/2, SULT1A3/4, SPN, QPRT, c16orf54, KIF22, AMZ, PRRT2, c16orf53, MVP, CDIPT, SEZ6L2, ASPHD1, KCTD13, LOC124446, HIRIP3, CCDC95, DOC2A, FAM57B, ALDOA, PPP4C, YPEL3, GDPD3, MAPK3, CORO1A, TAOK2, and TBX6.

In one embodiment, the segmental duplication that flanks the about 500 kb microdeletion on chromosome 16p11.2 is 147 kb.

In another embodiment, provided herein is a method for diagnosing ASD and/or autism in an individual, the method comprising detecting a microduplication on chromosome 15q13.2q13.3 wherein the presence of a about 0.500 Mb or larger microduplication on chromosome 15q13.2q13.3 in the genome of the individual is indicative that the individual is likely affected with ASD and/or autism. In one embodiment, the microduplication on chromosome 15q13.2q13.3 occurs between BP4-BP5 region. In some embodiments, the microduplication is between about 0.500 Mb to about 2 Mb long.

In one embodiment, provided herein is a method for diagnosing ASD and/or autism in an individual, the method comprising detecting a microdeletion on chromosome 15q13.2q13.3 wherein the presence of a about 0.500 Mb or larger microdeletion on chromosome 15q13.2q13.3 in the genome of the individual indicates that the individual is indicative that the individual is likely affected with ASD and/or autism. In one embodiment, the microdeletion on chromosome 15q13.2q13.3 occurs between BP4-BP5 region. In one embodiment, the microdeletion is between about 0.500 Mb to about 2 Mb long.

In some embodiments, the microdeletion or microduplication on chromosome 15q13.2q13.3, BP4-BP5 involves the deletion or duplication of any of the genes selected from the group consisting of: MTMR15, MTMR10, TRPM1, KLF13, OTUD7A, has-mir-211 and CHRNA7.

In one embodiment, the detection is performed using an oligonucleotide-based array comparative genomic hybridization (oligonucleotide-based CGH). The oligonucleotide-based array should have oligonucleotides covering any of these genes: BOLA2, GIYD1/2, SULTI1A3/4, SPN, QPRT, c16orf54, KIF22, AMZ, PRRT2, c16orf53, MVP, CDIPT, SEZ6L2, ASPHD1, KCTD13, LOC124446, HIRIP3, CCDC95, DOC2A, FAM57B, ALDOA, PPP4C, YPEL3, GDPD3, MAPK3, CORO1A, TAO K2, TBX6, MTMR15, MTMR10, TRPM1, KLF13, OTUD7A and CHRNA7.

In one embodiment, the detection is performed using a bacterial artificial chromosome-based array comparative genomic hybridization (BAC-based CGH).

In one embodiment, the detection is performed using a fluorescence in situ hybridization (FISH).

In one embodiment, the detection is performed using an multiplex ligation-dependent probe amplification (MLPA). MLPA probes designed for these genes: BOLA2, GIYD1/2, SULTI1A3/4, SPN, QPRT, c16orf54, KIF22, MAZ, PRRT2, c16orf53, MVP, CDIPT, SEZ6L2, ASPHD1, KCTD13, LOC124446, HIRIP3, CCDC95, DOC2A, FAM57B, ALDOA, PPP4C, YPEL3, GDPD3, MAPK3, CORO1A, TAO K2, TBX6, MTMR15, MTAR10, TRPM1, KLF13, OTUD7A, has-mir-211 and CHRNA7 are used.

BRIEF DESCRIPTION OF THE DRAWINGS

FIG. 2A shows the deletion of three consecutive targets (underlined with rectangular bar) which was confirmed by dye-swap array CGH. Note the symmetrical opposite ratios between forward-labeled (downward-shift) and reverse-labeled (upward-shift) array CGH. FIG. 2B shows that the 244K whole-genome oligonucleotide-array CGH confirmation of the deletion. The rectangular bar underlines the deleted region. Note the entire CARKL gene deletion and the partial CTNS gene deletion (forward labeling only). FIG. 2C shows that the multiplex ligation-dependent probe amplification (MLPA) confirmation of the deletion. The trace in lighter gray is a sample from a healthy control individual; the trace in darker gray is the patient sample. The dosage of CTNS exons 2 and 6 appears reduced by half (underlined with the rectangular bar), whereas the dosage of CTNS exon 12 is unchanged.

FIG. 3A-3C shows the regions of microdeletion and microduplication on Chromosome 16p11.2. FIG. 3A shows normalized intensity data that are averaged every 11 to 12 probes across a 2-Mb region on chromosome 16. Means (closed circles) and standard deviations (vertical bars) for subjects with normal copy numbers are shown; subjects with duplication are denoted with open circles, and those with deletions are denoted with triangles. Annotated genes in the region of interest are shown (not to scale), with gray denoting brain expression and black denoting unknown or little brain expression. Arrows represent the segmental duplications mediating the rearrangements, with three genes located within the segmental duplication. FIG. 3B shows both the deletion and duplication graphs showing shifted overlaying of two traces of multiplex ligation-dependent probe amplification (MLPA). Black tracings in both graphs represent a normal control sample. In the deletion graph, grey tracings show a sample with a 16p11.2 deletion; in the duplication graph, grey tracings show a sample with a 16p11.2 duplication. The MLPA profiles were generated by ABI 3730 Genetic Analyzer and normalized by GENEMARKER software (SoftGenetics). The four amplicons that are underlined with a black bar and shown with arrows are from probes located within the imbalanced 16p11.2 region. Amplicons labeled with C are control probes located either on chromosome 16 but outside the imbalanced region or on other chromosomes. FIG. 3C shows the oligo array CGH data from one clinical sample with the same chromosome 1 6p11.2 deletion and parents screened by a 244K whole genome array CGH platform at Children's Hospital Boston. On this scale, zero indicates that reference and test sample have equal copy number, below zero indicates that the Cy5 labeled sample has decreased copy number, and above zero indicates that the Cy5 labeled sample has increased copy number.

BRIEF LISTING OF THE TABLES

Figure 1:
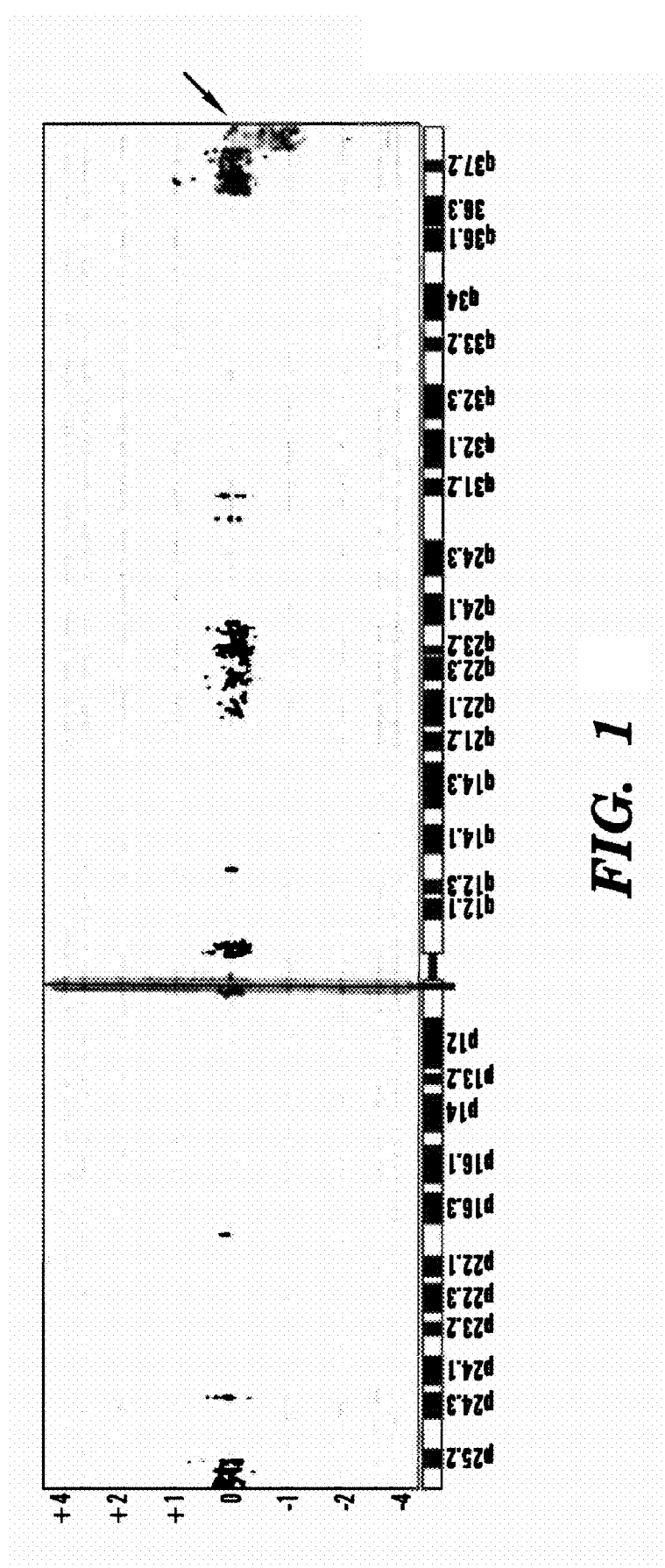
FIG. 1 shows the chromosome view of array CGH results showing a terminal deletion on 2q37.3. The arrow points to the targets with a downward-shifted $\log_2$ ratio.

Table 1 shows the genomic imbalance identified in clinical samples by oligonucleotide-array CGH and confirmed with alternative methods.

Table 2 shows the genomic coverage with Oligo Array CGH (CHB Version 1.0).

Table 3 shows the genomic imbalance (GI) detected in validation samples and comparison between oligonucleotide array results and alternate methods of detection Table 4 shows the detection of 16p11.2 copy-number variants according to sample.

Table 5 shows the duplication of chromosome 15q11-13 in AGRE sample.

Table 6 shows the phenotypic data in AGRE families and Iceland probands with copy number variants at 16p1 1.2. Family structure and ADI-R and ADOS subscores, as well as performance measures are given for AGRE families and Iceland probands with copy number variants at 16p1 1.2.

Table 7 shows the previously reported CNVs in ASD and/or autism. Events featured in the main tables or text of recent studies evaluating copy number in ASD and/or autism. For each reported event, events observed in the data with substantial overlap were included, and for inherited events, the number transmitted: not transmitted for affected offspring with data were also included. The current sample has some overlap with previously reported samples; * indicates a reported event in an overlapping sample which was also detect in this study. **, event not featured in the main text or tables of the paper, but listed in the supplementary table in an overlapping sample.

Table 8 shows the clinical information for Children's Hospital deletion cases (Pt#) and Iceland deletion cases (Aut#). Clinical descriptive information is given for the five subjects in the Children's Hospital Boston sample with deletions at 16p1 1.2, and the two subjects in the Iceland sample with deletions at 16p1 1.2 and clinical data available. The third Iceland subject has a history of seizures, but no other information available.

Table 9 shows the clinical information for Children's Hospital duplication cases. Clinical descriptive information is given for the four subjects in the Children's Hospital Boston sample with duplication at 16p1 1.2.

Table 10 shows the Iceland phenotype information. Clinical diagnosis by ICD-10 category and transmission information is listed for the Icelandic ASD and/or autism samples with deletions at 16p11.2.

Table 11 shows the chromosome 15q13.2q13.3 BP4-BP5 microduplications and microdeletions in individuals with ASD and/or autism.

Table 12 shows the multiplex ligation-dependent probe amplification (MLPA) probes for identifying microduplications and microdeletions at chromosome 15q13.2q13.3 BP4-BP5 and 16p11.2 loci.

DETAILED DESCRIPTION OF THE INVENTION

Embodiments of the invention are based upon a discovery of several genomic imbalances on chromosomes 15 and 16 of human subjects that have been diagnosed with autism spectrum disorder (ASD) and/or autism. The genomic imbalances are microdeletions and microduplications on chromosomes 15 and 16 of such subjects.

The inventors found a recurrent microdeletion at chromosome 16, more precisely at 16p11.2, in at least five human individuals diagnosed with ASD and/or autism. The microdeletion involves about 593 kilo-bases (kb) deletion within the 29.5 Mb-31.1 Mb region which is also flanked on both side with a segmental duplication of about 147 kb. The recurrent 16p11.2 microdeletion is also confirmed in five clinical samples of children with autism spectrum disorder. The sizes of the microdeletions ranged from about 455 kb to about 593 kb.

For other individuals diagnosed with ASD and/or autism, the inventors found a recurrent reciprocal microduplication at the same region in chromosome 16, at 16p11.2. Similar to the microdeletions, the reciprocal microduplications are about 500 to about 600 kb long within the 29.5 Mb-31.1 Mb region and are also flanked on both side with a segmental duplication of 147 kp. The recurrent 16p11.2 microduplication was also confirmed in four clinical samples of children with autism spectrum disorder. The sizes of the microduplications ranged from about 544 kb to about 691 kb.

The proximal portion of chromosome 15q is a well known region of genomic instability that contains many segmental duplications. Recurrent large genomic duplications have been found in the Prader-Willi/Angelman (15q11-q13) region. Deletions at 15q11-q13 that result in Prader-Willi syndrome and Angelman syndrome (PWS/AS) are typically about 4 Mb, and are mediated by repetitive elements with clustered breakpoints (BP) at either of two proximal sites (BP1 and BP2) and one distal site (BP3). Such deletions were not identified in the ASD human subjects.

Here, the inventors found a recurrent genomic segmental microduplication and/or microdeletion specifically at breakpoints BP4-BP5 of chromosome 15q13.2q13.3 in human individuals diagnosed with ASD and/or autism.

The inventors analyzed DNA samples from 1,445 unrelated human patients submitted consecutively for clinical array comparative genomic hybridization (CGH) testing at Children's Hospital Boston and DNA samples from 1,441 individuals with ASD and/or autism from 751 families in the Autism Genetic Resource Exchange (AGRE) repository. The microduplications and/or microdeletions at 15q13.2q13.3, BP4-BP5 and 16p11.2 were initially noted in single nucleotide polymorphism (SNP) genotyping which covered regions of known common copy number polymorphism and were then later confirmed by oligonucleotide-based array CGH, and by FISH and multiplex ligation-dependent probe amplification (MLPA) using probes to specific genes found in the microduplications and microdeletions regions.

Autism Spectrum Disorders (ASD), also known as Pervasive Developmental Disorders (PDDs), cause severe and pervasive impairment in thinking, feeling, language, and the ability to relate to others. These disorders are usually first diagnosed in early childhood and range from a severe form, called autistic disorder, through pervasive development disorder not otherwise specified (PDD-NOS), to a much milder form, Asperger syndrome. They also include two rare disorders, Rett syndrome and childhood disintegrative disorder. It is important to note that these disorders are not necessarily associated with mental retardation (Diagnostic and Statistical Manual of Mental Disorders published by the American Psychiatric Association (DSM-IV, 4$^{th}$ edition)).

Prevalence studies have been done in several states and also in the United Kingdom, Europe, and Asia. A recent study of a U.S. metropolitan area estimated that 3.4 of every 1,000 children 3-10 years old had ASD and/or autism. This wide range of prevalence points to a need for earlier and more accurate screening for the symptoms of ASD. The earlier the disorder is diagnosed, the sooner the child can be helped through treatment interventions. Pediatricians, family physicians, daycare providers, teachers, and parents may initially dismiss signs of ASD, optimistically thinking the child is just a little slow and will "catch up." Although early intervention has a dramatic impact on reducing symptoms and increasing a child's ability to grow and learn new skills, it is estimated that only 50 percent of children are diagnosed before kindergarten.

All children with ASD and/or autism demonstrate deficits in 1) social interaction, 2) verbal and nonverbal communication, and 3) repetitive behaviors or interests. In addition, they will often have unusual responses to sensory experiences, such as certain sounds or the way objects look. Each of these symptoms runs the gamut from mild to severe. They will present in each individual child differently. For instance, a child may have little trouble learning to read but exhibit extremely poor social interaction. Each child will display communication, social, and behavioral patterns that are individual but fit into the overall diagnosis of ASD.

Children with ASD and/or autism do not follow the typical patterns of child development. In some children, hints of future problems may be apparent from birth. In most cases, the problems in communication and social skills become more noticeable as the child lags further behind other children the same age. Some other children start off well enough. Often times between 12 and 36 months old, the differences in the way they react to people and other unusual behaviors become apparent. Some parents report the change as being sudden, and that their children start to reject people, act strangely, and lose language and social skills they had previously acquired. In other cases, there is a plateau, or leveling, of progress so that the difference between the child with ASD and/or autism and other children the same age becomes more noticeable.

ASD is defined by a certain set of behaviors that can range from the very mild to the severe.

ASD has been associated with mental retardation (MR). It is said that between 75% and 90% of all autistics are mentally retarded. However, having ASD and/or autism does not necessarily mean that one will have MR. ASD and/or autism occurs at all IQ levels, from genius levels to the severely learning-disabled.

According to the Diagnostic and Statistical Manual of Mental Disorders (DSM-IV, 4$^{th}$ edition) that is published by the American Psychiatric Association to provide diagnostic criteria for mental disorders, MR and ASD are diagnosed using different sets of criteria. The essential feature of MR is significant sub-average general intellectual functioning (Criterion A) that is accompanied by significant limitations in adaptive functioning in at least two of the following skill areas: communication, self care, home living, social/interpersonal skills, use of community resources, self-direction, functional academic skills, work, leisure, health, and safety (Criterion B). The onset must occur before 18 years (Criterion C).

The essential features of ASD are the presence of markedly abnormal or impaired development in social interaction and communication and a markedly restricted repertoire of activity and interest. Below is the list of diagnostic criteria for ASD defined in DSM-IV:

A. A total of six (or more) items from (1), (2), and (3), with at least two from (1), and one of each from (2) and (3):
  (1) quantitative impairment in social interaction, as manifested by at least two of the following:
    a. marked impairment in the use of multiple nonverbal behaviors such as eye-to-eye gave, facial expression, body posture, and gesture to regulate social interaction
    b. failure to develop peer relationships appropriate to developmental level
    c. a lack of spontaneous seeking to share enjoyment, interest, or achievements with other people (e.g. by a lack of showing, bring, or pointing out objects of interest)
    d. lack of social or emotional reciprocity
  (2) quantitative impairment in communication as manifested by at least two of the following:
    a. delay in, or total lack of, the development of spoken language (not accompanied by an attempt to compensate through alternative modes of communication such as gesture or mime)
    b. in individual with adequate speech, marked impairment in the ability to initiate or sustain conversation with others
    c. stereotype and repetitive use of language or idiosyncratic language
    d. lack of varied, spontaneous make-believe play or social imitative play appropriate to developmental level
  (3) restrictive repetitive and stereotyped patterns of behavior, interest, and activities, as manifested by at least two of the following:
    a. encompassing preoccupation with one or more stereotyped and restricted pattern of interest that is abnormal either in intensity or focus
    b. apparently inflexible adherence to specific, nonfunctional routines or rituals
    c. stereotyped and repetitive motor mannerism (e.g. hand or finger flapping or twisting, or complex whole-body movements)
    d. persistent preoccupation with parts of object
B. Delays or abnormal functioning in at least one of the following areas, with onset prior to age 3 years: (1) social interaction, (2) language use in social communication, or (3) symbolic or imaginative play.
C. The disturbance is not better accounted for Rett's Disorder or childhood disintegrative disorder.

Furthermore, there is a distinction between ASD/autism and MR. People with MR generally show even skill development, whereas individuals with ASD and/or autism typically show uneven skill development. Individuals with ASD and/or autism can be very good at certain skills, such as music or mathematical calculation, yet perform poorly in other areas, especially social communication and social interaction. It is important to distinguish ASD and/or autism from mental retardation or other disorders since diagnostic confusion can result in referral to inappropriate and ineffective treatment techniques. It is more accurate to class ASD and/or autism as a developmental disability, and not a mental illness.

Currently, there is no single test for ASD and/or autism. In evaluating a child, clinicians rely on behavioral characteristics to make a diagnosis, as described above. Some of the characteristic behaviors of ASD and/or autism can be apparent in the first few months of a child's life, or they can appear at any time during the early years. For the diagnosis, problems in at least one of the areas of communication, socialization, or restricted behavior must be present before the age of 3. The diagnosis requires a two-stage process. The first stage involves developmental screening during "well child" checkups; the second stage entails a comprehensive evaluation by a multidisciplinary team.

In one embodiment, diagnosis is by the Autism Diagnostic Interview-Revised (ADI-R) (Lord C, et al., 1993, Infant Mental Health, 14:234-52). In another embodiment, diagnosis is by symptoms fitting an AGRE classification of ASD and/or autism, broad spectrum (patterns of impairment along the spectrum of pervasive developmental disorders, including PDD-NOS and Asperger's syndrome).

Recent studies strongly suggest that some people have a genetic predisposition to developing ASD and/or autism. In families with one autistic child, the risk of having a second child with the disorder is approximately 5 percent, or one in 20. This is greater than the risk for the general population.

The present discoveries is useful for making a diagnosis as well as a prediction of the probability and/or likelihood of developing ASD.

Accordingly, provided herein is a method for diagnosing of autism and autism spectrum disorders using genetic analysis to identify the presence of a about 593 kb deletion in chromosome 16p11.2 or a reciprocal duplication within the 29.5 Mb-31.1 Mb region, and the presence of a segmental duplicate sequence of 147 kb flanking the about 593 kb deletion or reciprocal duplication region.

In addition, provided herein is a method for diagnosing of autism and autism spectrum disorders using genetic analysis to identify the presence of microdeletion or microduplication on chromosome 15 q13.2q13.3, wherein the microdeletion or microduplication can vary in sizes from about 0.500 Mb to about 2.0 Mb long.

In one embodiment, provided herein is a method for diagnosing ASD and/or autism in an individual, the method comprising the steps of: (a) detecting a microdeletion on chromosome 16p11.2; and (b) detecting a segmental duplication on chromosome 16p11.2; wherein the presence of an about 400-700 kb microdeletion that is flanked by an about 100 kb segmental duplication on chromosome 16p11.2 in the genome of the individual is indicative that the individual is likely affected with ASD and/or autism. The individual is preferably a human.

In another embodiment, provided herein is a method for diagnosing ASD and/or autism in an individual, the method comprising the steps of: (a) detecting a microduplication on chromosome 16p11.2; and (b) detecting a segmental duplication on chromosome 16p11.2; wherein the presence of an about 400-700 kb microduplication that is flanked by an about 100 kb segmental duplication on chromosome 16p11.2 in the genome of the individual is indicative that the individual is likely affected with ASD and/or autism. The individual is preferably a human.

In one embodiment, the individual is suspected of having ASD and/or autism. In another embodiment, the individual is asymptomatic but has a family history of ASD In one embodiment, the individual is a human. In one embodiment, the individual is a human fetus of at least 10 weeks of gestation. In one embodiment, the individual is a human fetus between 10 weeks of gestation to full term, approximately 38 weeks of gestation.

Since ASD and/or autism does not necessary occur immediately from birth and can develop later in the life of a child, being able to predict the likelihood that a child can develop the disorder allows the parents and clinician to be more vigilant and be psychologically and medically prepared when the symptoms manifest. Twin studies suggest that ASD and/or autism has a strong genetic component. Parents with one or more autistic children and plan to have additional children can use the methods described herein to screen for the likelihood that any further biological child is predisposed to develop the disorder.

Accordingly, in one embodiment, provided herein is a method for predicting susceptibility or the likelihood of an individual in developing ASD and/or autism, the method comprising the steps of: (a) detecting a microdeletion on chromosome 16p11.2; and (b) detecting a segmental duplication on chromosome 16p11.2; wherein a presence of an about 400-700 kb microdeletion that is flanked by an about 100 kb segmental duplication on chromosome 16p11.2 in the genome of the individual indicative that the individual is susceptible to or likely to develop ASD and/or autism.

In another embodiment, provided herein is a method for predicting susceptibility or the likelihood of an individual in developing ASD and/or autism, the method comprising the steps of: (a) detecting a microduplication on chromosome 16p11.2; and (b) detecting a segmental duplication on chromosome 16p11.2; wherein a presence of an about 400-700 kb microduplication that is flanked by an about 100 kb segmental duplication on chromosome 16p11.2 in the genome of the individual indicative that the individual is susceptible to or likely to develop ASD and/or autism.

In one embodiment, the about 400-700 kb microdeletion or microduplication, and the about 100 kb segmental duplication on chromosome 16p11.2 associated with ASD and/or autism occurs within the 29.5 Mb-30.1 Mb region.

In one embodiment, the about 400-700 kb microdeletion or microduplication, and the about 100 kb segmental duplication on chromosome 16p11.2 associated with ASD and/or autism occurs within the 29.5 Mb-31.1 Mb region.

In one embodiment, the about 400-700 kb microdeletion or microduplication, and the about 100 kb segmental duplication on chromosome 16p11.2 associated with ASD and/or autism occurs in region 29,362,092-30,255,393 on chromosome 16 according to the Human Genome Build 18 (Hg 18; March, 2006).

In one embodiment, the microdeletion at 16p11.2, 29.5 Mb-31.1 Mb region is about 500 kb long. In one embodiment, the microdeletion at 16p11.2, 29.5 Mb-31.1 Mb region is 500 kb long. In some embodiments, the microdeletion is approximately 445 kb, 544 kb, 546 kb, 593 kb or 653 kb long. In some embodiments, the microdeletion is between about 400 kb to about 500 kb long, including all the whole integers between 400 and 500. In some embodiments, the microdeletion is between about 500 kb to about 600 kb long, including all the whole integers between 500 and 600. In some embodiments, the microdeletion is between about 400 kb to about 700 kb long, including all the whole integers between 400 and 700. In some embodiments, the microdeletion is between about 600 kb to about 700 kb long, including all the whole integers between 600 and 700.

In one embodiment, the about 400-700 kb microdeletion and the about 100 kb segmental duplication on chromosome 16p11.2 associated with ASD and/or autism occurs in region 29,581,455 to 30,027,260 on chromosome 16 according to the Human Genome Build 18 (Hg 18; March, 2006).

In one embodiment, the about 400-700 kb microdeletion and the about 100 kb segmental duplication on chromosome 16p11.2 associated with ASD and/or autism occurs in region 29,560,500 to 30,104,842 on chromosome 16 according to the Human Genome Build 18 (Hg 18; March, 2006).

In one embodiment, the about 400-700 kb microdeletion and the about 100 kb segmental duplication on chromosome 16p11.2 associated with ASD and/or autism occurs in region 29,560,500 to 30,106,852 on chromosome 16 according to the Human Genome Build 18 (Hg 18; March, 2006).

In one embodiment, the about 400-700 kb microdeletion and the about 100 kb segmental duplication on chromosome 16p11.2 associated with ASD and/or autism occurs in region 29,362,092 to 30,015,022 on chromosome 16 according to the Human Genome Build 18 (Hg 18; March, 2006).

In one embodiment, the microduplication at 16p11.2, 29.5 Mb-31.1 Mb region is about 500 kb long. In one embodiment, the microduplication at 16p11.2, 29.5 Mb-31.1 Mb region is 500 kb long. In some embodiments, the microduplication is approximately 544 kb, 658 kb, or 691 kb long. In some embodiments, the microduplication is between about 500 kb to about 600 kb long, including all the whole integers between 500 and 600. In some embodiments, the microduplication is between about 500 kb to about 700 kb long, including all the whole integers between 500 and 700. In some embodiments, the microduplication is between about 600 kb to about 700 kb long, including all the whole integers between 600 and 700.

In one embodiment, the about 400-700 kb microduplication and the about 100 kb segmental duplication on chromosome 16p11.2 associated with ASD and/or autism occurs in region 29,560,500 to 30,255,393 on chromosome 16 according to the Human Genome Build 18 (Hg 18; March, 2006).

In one embodiment, the about 400-700 kb microduplication is a reciprocal microduplication of the microdeletion on the same region in chromosome 16p11.2 that is mediated by the segmental duplications that are also found in the flanking either the microduplications or microdeletions.

In one embodiment, the about 400-700 kb microduplication and the about 100 kb segmental duplication on chromosome 16p11.2 associated with ASD and/or autism occurs in region 29,581,455 to 30,240,082 on chromosome 16 according to the Human Genome Build 18 (Hg 18; March, 2006).

In one embodiment, the about 400-700 kb microduplication and the about 100 kb segmental duplication on chromosome 16p11.2 associated with ASD and/or autism occurs in region 29,560,500 to 30,255,393 on chromosome 16 according to the Human Genome Build 18 (Hg 18; March, 2006).

In one embodiment, the about 400-700 kb microduplication and the about 100 kb segmental duplication on chromosome 16p11.2 associated with ASD and/or autism occurs in region 29,560,500 to 30,104,842 on chromosome 16 according to the Human Genome Build 18 (Hg 18; March, 2006).

As used herein, the term "about" refers to a range of 1% to 3% more or less of the length of a sequence described herein. For example, about 500 kb long refers to a range of 1% to 3% more of 500 kb, or 1% to 3% less of 500 kb. All ranges between 1% and 3% including decimals of 1% and 3% are included herein, for example, 1%, 2%, 3%, 1.3%, 1.7%, 2.2%, 2.7% etc.

In one embodiment, the microdeletions or reciprocal microduplications at 16p11.2, 29.5 Mb-31.1 Mb region, are flanked by segmental duplications of about 100 kb long. In one embodiment, the flanking segmental duplication is 100 kb long. In another embodiment, the segmental duplication is about 147 kb long. In some embodiments, the segmental duplication is between about 100 to about 147 kb long, including all the whole integers between 100 and 147. In another embodiment, the microduplication is 147 kb long. In some embodiments, the microduplication is between 100 to 147 kb long, including all the whole integers between 100 and 147.

In one embodiment, the flanking segmental duplication is surrounding or within the region 29,368,017 to 29,514,353 (147 kb segmental duplication at the left site of the about 400-700 kb microdeletion or microduplication); and the second segmental duplication occurs surrounding or within 30,107 356 to 30,254,369 (147 kb segmental duplication at the right site of the about 400-700 kb microdeletion or microduplication) on chromosome 16 according to the Human Genome Build 18 (Hg 18; March, 2006).

In one embodiment, the DNA sequence of the 147 kb duplication is chr16:29368017-29514353 of the Human Genome Build 18 (Hg 18; March, 2006) (SEQ. ID. No. 54). In another embodiment, the DNA sequence of the 147 kb duplication is chr16:30107356-30254369 of the Human Genome Build 18 (Hg 18; March, 2006) (SEQ. ID No. 55). In other embodiments, the DNA sequence of the 147 kb duplication is at least 90%, at least 91%, at least 92%, at least 93%, at least 94%, at least 95%, at least 96%, at least 97%, at least 98%, or at least 99%, including to the decimals of percentages between 90%-100%, homologous to SEQ. ID. No. 54 or 55.

In one embodiment, the microdeletion or reciprocal microduplication at 16p11.2, 29,362,092-33,255,393 region comprises at least one, two, three, four, five, six, seven, eight, nine, ten, 11, 12, 13, 14, 15, 16, 17, 18, 19, 20, 21, 22, 23, 24, 25, 26, 27, or 28 of the following genes: BOLA2 (mRNA Genbank Accession No. NM_001031827.1), GIYD1/2 (mRNA Genbank Accession No. NM_001014999; NM_001015000.1), SULTI1A3/4 (mRNA Genbank Accession No. NM_003166.3; NM_177552.2), SPN (mRNA Genbank Accession No. NM_003123), QPRT (mRNA Genbank Accession No. NM_014298.3), c16orf54 (mRNA Genbank Accession No. NM_175900.3), KIF22 (mRNA Genbank Accession No. NM_007317.1), AMZ (mRNA Genbank Accession No. NM_003123), PRRT2 (mRNA Genbank Accession No. NM_145239.2), c16orf53 (mRNA Genbank Accession No. NM_024516.3), MVP (mRNA Genbank Accession No. NM_005115.3; NM_017458.2), CDIPT (mRNA Genbank Accession No. NM_006319.3), SEZ6L2 (mRNA Genbank Accession Nos. NM_001114099.1; NM_001114100.1; NM_012410.2; NM_201575.2), ASPHD1 (mRNA Genbank Accession No. NM_181718.3), KCTD13 (mRNA Genbank Accession No. NM_178863.2), LOC124446 (mRNA Genbank Accession No. NM_001083613.1; NM_194280.3), HIRIP3 (mRNA Genbank Accession No. NM_003609.2), CCDC95 (mRNA Genbank Accession No. NM_173618.1), DOC2A (mRNA Genbank Accession No. NM_003586.2), FAM57B (mRNA Genbank Accession No. NM_031478.4), ALDOA (mRNA Genbank Accession No. NM_000034.2; NM_001127617.1; NM_184041.1; NM_184043.1), PPP4C (mRNA Genbank Accession No. NM_002720.1), YPEL3 (mRNA Genbank Accession No. NM_031477.4), GDPD3 (mRNA Genbank Accession No. NM_024307.2)), AMPK3 (mRNA Genbank Accession No. NM_001040056.1; NM_001109891.1; NM_002746.2), CORO1A (mRNA Genbank Accession No. NM_007074.2), TAO K2 (mRNA Genbank Accession No. NM_003123), and TBX6 (mRNA Genbank Accession No. NM_003123) (See FIG. 3A).

In one embodiment, the microdeletion or reciprocal microduplication at 16p11.2, 29,362,092-33,255,393 region consists of at least one, two, three, four, five, six, seven, eight, nine, ten, 11, 12, 13, 14, 15, 16, 17, 18, 19, 20, 21, 22, 23, 24, 25, 26, 27, or 28 of the following genes: BOLA2 (mRNA Genbank Accession No. NM_001031827.1), GIYD1/2 (mRNA Genbank Accession No. NM_001014999; NM_001015000.1), SULTI1A3/4 (mRNA Genbank Accession No. NM_003166.3; NM_177552.2), SPN (mRNA Genbank Accession No. NM_003123), QPRT (mRNA Genbank Accession No. NM_014298.3), c16orf54 (mRNA Genbank Accession No. NM_175900.3), KIF22 (mRNA Genbank Accession No. NM_007317.1), MAZ (mRNA Genbank Accession No. NM_003123), PRRT2 (mRNA Genbank Accession No. NM_145239.2), c16orf53 (mRNA Genbank Accession No. NM_024516.3), MVP (mRNA Genbank Accession No. NM_005115.3; NM_017458.2), CDIPT (mRNA Genbank Accession No. NM_006319.3), SEZ6L2 (mRNA Genbank Accession Nos. NM_001114099.1; NM_001114100.1; NM_012410.2; NM_201575.2), ASPHD1 (mRNA Genbank Accession No. NM_181718.3), KCTD13 (mRNA Genbank Accession No. NM_178863.2), LOC124446 (mRNA Genbank Accession No. NM_001083613.1; NM_194280.3), HIRIP3 (mRNA Genbank Accession No. NM_003609.2), CCDC95 (mRNA Genbank Accession No. NM_173618.1), DOC2A (mRNA Genbank Accession No. NM_003586.2), FAM57B (mRNA Genbank Accession No. NM_031478.4), ALDOA (mRNA Genbank Accession No. NM_000034.2; NM_001127617.1; NM_184041.1; NM_184043.1), PPP4C (mRNA Genbank Accession No. NM_002720.1), YPEL3 (mRNA Genbank Accession No. NM_031477.4), GDPD3 (mRNA Genbank Accession No. NM_024307.2)), MAPK3 (mRNA Genbank Accession No.

NM_001040056.1; NM_001109891.1; NM_002746.2), CORO1A (mRNA Genbank Accession No. NM_007074.2), TAO K2 (mRNA Genbank Accession No. NM_003123), and TBX6 (mRNA Genbank Accession No. NM_003123) (See FIG. 3A).

In one embodiment, the microdeletion or reciprocal microduplication at 16p11.2, 29,362,092-33,255,393 region consists essentially of at least one, two, three, four, five, six, seven, eight, nine, ten, 11, 12, 13, 14, 15, 16, 17, 18, 19, 20, 21, 22, 23, 24, 25, 26, 27, or 28 of the following genes: BOLA2 (mRNA Genbank Accession No. NM_001031827.1), GIYD1/2 (mRNA Genbank Accession No. NM_001014999; NM_001015000.1), SULT1A3/4 (mRNA Genbank Accession No. NM_003166.3; NM_177552.2), SPN (mRNA Genbank Accession No. NM_003123), QPRT (mRNA Genbank Accession No. NM_014298.3), c16orf54 (mRNA Genbank Accession No. NM_175900.3), KIF22 (mRNA Genbank Accession No. NM_007317.1), MAZ (mRNA Genbank Accession No. NM_003123), PRRT2 (mRNA Genbank Accession No. NM_145239.2), c16orf53 (mRNA Genbank Accession No. NM_024516.3), MVP (mRNA Genbank Accession No. NM_005115.3; NM_017458.2), CDIPT (mRNA Genbank Accession No. NM_006319.3), SEZ6L2 (mRNA Genbank Accession Nos. NM_001114099.1; NM_001114100.1; NM_012410.2; NM_201575.2), ASPHD1 (mRNA Genbank Accession No. NM_181718.3), KCTD13 (mRNA Genbank Accession No. NM_178863.2), LOC124446 (mRNA Genbank Accession No. NM_001083613.1; NM_194280.3), HIRIP3 (mRNA Genbank Accession No. NM_003609.2), CCDC95 (mRNA Genbank Accession No. NM_173618.1), DOC2A (mRNA Genbank Accession No. NM_003586.2), FAM57B (mRNA Genbank Accession No. NM_031478.4), ALDOA (mRNA Genbank Accession No. NM_000034.2; NM_001127617.1; NM_184041.1; NM_184043.1), PPP4C (mRNA Genbank Accession No. NM_002720.1), YPEL3 (mRNA Genbank Accession No. NM_031477.4), GDPD3 (mRNA Genbank Accession No. NM_024307.2)), MAPK3 (mRNA Genbank Accession No. NM_001040056.1; NM_001109891.1 NM_002746.2), CORO1A (mRNA Genbank Accession No. NM_007074.2), TAO K2 (mRNA Genbank Accession No. NM_003123), and TBX6 (mRNA Genbank Accession No. NM_003123) (See FIG. 3A).

In one embodiment, the microdeletion or reciprocal microduplication at 16p11.2, 29,362,092-33,255,393 region comprises all these four genes: SPN, MAZ, TAO K2, and TBX6.

In one embodiment, the microdeletion or reciprocal microduplication at 16p11.2, 29,362,092-33,255,393 region consists of all these four genes: SPN, MAZ, TAO K2, and TBX6.

In one embodiment, the microdeletion or reciprocal microduplication at 16p11.2, 29,362,092-33,255,393 region consists essentially of all these four genes: SPN, MAZ, TAO K2, and TBX6.

A skilled artisan in the art will be able to design oligonucleotide probes for use in the various detection methods known in the art, e.g. FISH, MLPA, oligonucleotide-based array CGH, to detect the deletion or duplication of these genes in the genomic DNA (nucleic acid sample) of the individual tested.

SPN (mRNA Genbank Accession No. NM_003123) is sialophorin (genomic Genbank Accession no. NC_000016.8, GI:51511732; Region: 29581801-29589329; GenomeProject:168; Ensembl:ENSG00000197471) (SEQ. ID. No. 43). Sialophorin (leukosialin) is a major sialoglycoprotein on the surface of human T lymphocytes, monocytes, granulocytes, and some B lymphocytes, which appears to be important for immune function and may be part of a physiologic ligand-receptor complex involved in T-cell activation. This gene can be found on Chromosome 16 at location 29,581,801-29,589,312. The start of this gene is located in Contig AC009086.6.1.201155.

MAZ (mRNA Genbank Accession No. NM_002383) is MYC-associated zinc finger protein (purine-binding transcription factor). Synonyms: Pur-1, ZF87, Zif87, ZNF801. (genomic Genbank Accession no. NC_000016.8 GI:51511732; Region: 29725356-29730005; GenomeProject:168; Ensembl:ENSG00000103495) (SEQ. ID. No. 44). This gene can be found on Chromosome 16 at location 29,725,356-29,730,003. The start of this gene is located in Contig AC009133.7.1.174363.

TAO K2 (mRNA Genbank Accession No. NM_016151) is TAO kinase 2 which is also known as PSK; PSK1; TAO1; TAO2; MAP3K17; KIAA0881; Serine/threonine-protein kinase TAO2 (EC 2.7.11.1); Thousand and one amino acid protein 2; Prostate-derived STE20-like kinase 1, (PSK-1); and Kinase from chicken homolog C, (hKFC-C). (Genomic Genbank Accession no. NC_000016.8 GI:51511732; Region: 29892723-29911082; GenomeProject: 168; Ensembl:ENSG00000149930) (SEQ. ID. No. 45). This gene can be found on Chromosome 16 at location 29,892,723-33,861, 588. The start of this gene is located in Contig AC093512.2.1.157481.

TBX6, T-box transcription factor (T-box protein 6), (mRNA Genbank Accession No. NM_004608; NM_080758) is a member of a phylogenetically conserved family of genes that share a common DNA-binding domain, the T-box. T-box genes encode transcription factors that are involved in the regulation of developmental processes. Knockout studies in mice indicate that this gene is important for specification of paraxial mesoderm structures. It is also known as T-box 6 or DFNB67. (Genomic Genbank Accession no. NC_000016.8 GI:51511732; Region: complement (30004583-30010709); GenomeProject: 168; Ensembl: ENSG00000149922) (SEQ. ID. No. 46). This gene can be found on Chromosome 16 at location 30,004,583-30,010, 709. The start of this gene is located in Contig AC012645.7.1.192943.

BOLA2 (mRNA Genbank Accession No. NM_001031827.1) is BolA-like protein 2. It is also known as My016 and BOLA2A. BolA-like proteins are widely conserved from prokaryotes to eukaryotes, and these proteins seem to be involved in cell proliferation or cell-cycle regulation. BOLA2 is a member of the BolA Super-family. This family consist of the morphoprotein BolA from *E. coli* and its various homologues. In *E. coli*, over expression of this protein causes round morphology and may be involved in switching the cell between elongation and septation systems during cell division. The expression of BolA is growth rate regulated and is induced during the transition into the stationary phase. BolA is also induced by stress during early stages of growth and may have a general role in stress response. It has also been suggested that BolA can induce the transcription of penicillin binding proteins 6 and 5. This gene is located within a region of a segmental duplication on chromosome 16p. (Genomic Genbank Accession no. NC_000016.8 GI:51511732; Region: complement (29,362,071-29,373,786); GenomeProject:168; Ensembl:ENSG00000183336) (SEQ. ID. No. 56). This gene can be found on Chromosome 16 at location 30,004,583-30,010,709.

GIYD1/2 (mRNA Genbank Accession No. NM_001014999.1; NM_001015000.1) is GIY-YIG domain containing 1 isoform 1 and isoform 2 protein. It is also known as GIYD1. This isoform 1 is the longer isoform. The GIY- YIG catalytic domain is found in the amino terminal region of excinuclease abc subunit c (uvrC), bacteriophage T4 endonucleases segA, segB, segC, segD and segE; it is also found in putative endonucleases encoded by group I introns of fungi and phage. A segmental duplication of the p arm of chromosome 16 created two identical copies of the GIY-YIG domain containing gene, this record represents the more centromeric copy. Exons of this gene overlap with exons of the phenol-preferring sulfotransferase (SULT1A3) gene. Two transcript variants that encode different protein isoforms have been identified through sequence analysis. (Genomic Genbank Accession no. NC_000016.8 GI:51511732; Region: complement (30,112,718-30,116,383); GenomeProject:168; Ensembl:ENSG00000132207) (SEQ. ID. No. 57). This gene can be found on Chromosome 16 at location 30,004,583-30,010,709.

SULTI1A3/4 (mRNA Genbank Accession No. NM_003166.3; NM_177552.2) is sulfotransferase family, cytosolic, 1A, phenol-preferring, member 3. It is also known as HAST, HAST3, M-PST, MGC117469, ST1A5, STM, SULT1A4, and TL-PST. Sulfotransferase enzymes catalyze the sulfate conjugation of many hormones, neurotransmitters, drugs, and xenobiotic compounds. These cytosolic enzymes are different in their tissue distributions and substrate specificities. The gene structure (number and length of exons) is similar among family members. This gene encodes a phenol sulfotransferase with thermolabile enzyme activity. Four sulfotransferase genes are located on the p arm of chromosome 16; this gene and SULT1A4 arose from a segmental duplication. This gene is the most centromeric of the four sulfotransferase genes. Exons of this gene overlap with exons of a gene that encodes a protein containing GIY-YIG domains (GIYD1). Multiple alternatively spliced variants that encode the same protein have been described. (Genomic Genbank Accession no. NC_000016.8 GI:51511732; Region: complement (30,113,244-30,123,151); GenomeProject: 168; Ensembl:ENSG00000213599) (SEQ. ID. No. 58).

QPRT (mRNA Genbank Accession No. NM_014298.3) is quinolinate phosphoribosyltransferase, a key enzyme in catabolism of quinolinate, an intermediate in the tryptophan-nicotinamide adenine dinucleotide pathway. It is also is involved in the de novo synthesis of NAD in both prokaryotes and eukaryotes. Quinolinate acts as a most potent endogenous exitotoxin to neurons. Elevation of quinolinate levels in the brain has been linked to the pathogenesis of neurodegenerative disorders such as epilepsy, Alzheimer's disease, and Huntington's disease. It is also known as QPRTase and nicotinate-nucleotide pyrophosphorylase. (Genomic Genbank Accession no. NC_000016.8 GI:51511732; Region: complement (29,597,942-29,616,816); GenomeProject:168; Ensembl:ENSG00001103485) (SEQ. ID. No. 59).

C16orf54 (mRNA Genbank Accession No. NM_175900.3) is human chromosome 16 open reading frame 54. It is also known as FLJ35681, MGC129957, MGC129958, and hypothetical protein LOC283897. (Genomic Genbank Accession no. NC_000016.8 GI:51511732; Region: complement (29,661,285-29,664,841); GenomeProject:168; Ensembl:ENSG00000185905) (SEQ. ID. No. 60).

KIF22 (mRNA Genbank Accession No. NM_007317.1) is kinesin family member 22. It is also known as KID, KNSL4, OBP, OBP-1, OBP-2, kinesin-like 4, and oriP binding protein and origin of plasmid DNA replication-binding protein. It is a member of kinesin-like protein family. This protein family are microtubule-dependent molecular motors that transport organelles within cells and move chromosomes during cell division. The C-terminal half of this protein has been shown to bind DNA. Studies with the Xenopus homolog suggests its essential role in metaphase chromosome alignment and maintenance. (Genomic Genbank Accession no. NC_000016.8 GI:51511732; Region: complement (29,709,559-29,724, 207); GenomeProject:168; Ensembl: ENSG00000079616) (SEQ. ID. No. 61).

PRRT2 (mRNA Genbank Accession No. NM_145239.2) is proline-rich transmembrane protein 2. It is also known as DKFZp547J199 and FLJ25513. (Genomic Genbank Accession no. NC_000016.8 GI:51511732; Region: complement (29,730,910-29,734,703); GenomeProject: 168; Ensembl: ENSG00000167371) (SEQ. ID. No. 62).

C16orf53 (mRNA Genbank Accession No. NM_024516.3) is human chromosome 16 open reading frame 53. C16ORF53 (PA1) is a component of a Set1-like multiprotein histone methyltransferase complex. It is also known as FLJ22459, MGC4606, PA1, and PTIP-associated 1 protein. (Genomic Genbank Accession no. NC_000016.8 GI:51511732; Region: complement (29,735,029-29,741, 317); GenomeProject:168; Ensembl: ENSG00000185928) (SEQ. ID. No. 63).

MVP (mRNA Genbank Accession No. NM_005115.3; NM_017458.2) is major vault protein which is a lung resistance-related protein. Vaults are multi-subunit structures that may be involved in nucleo-cytoplasmic transport. This protein mediates drug resistance, perhaps via a transport process. It is widely distributed in normal tissues, and overexpressed in multidrug-resistant cancer cells. The protein overexpression is a potentially useful marker of clinical drug resistance. This gene produces two transcripts by using two alternative exon 2 sequences; however, the open reading frames are the same in both transcripts. It is also known as LRP and VAULT1 (Genomic Genbank Accession no. NC_000016.8 GI:51511732; Region: complement (29,731,591-29,766, 842); GenomeProject:168; Ensembl: ENSG00000013364) (SEQ. ID. No. 64).

CDIPT (mRNA Genbank Accession No. NM_006319.3) is CDP-diacylglycerol-inositol 3-phosphatidyltransferase (phosphatidylinositol synthase). It is involved in the biosynthesis of phosphatidylinositol. Phosphatidylinositol synthase, a member of the CDP-alcohol phosphatidyl transferase class-I family, is an integral membrane protein found on the cytoplasmic side of the endoplasmic reticulum and the Golgi apparatus. It is also known as MGC1328, PIS, PIS1, CDP-diacylglycerol-inositol 3-phosphatidyltransferase, PI synthase, and PtdIns synthase. (Genomic Genbank Accession no. NC_000016.8 GI:51511732; Region: complement (29,777, 179-29,782,079); GenomeProject: 168; Ensembl: ENSG00000103502) (SEQ. ID. No. 65).

SEZ6L2 (mRNA Genbank Accession Nos. NM_001114099.1; NM_001114100.1; NM_012410.2; NM_201575.2) is seizure related 6 homolog (mouse)-like 2. It is also known as FLJ90517, PSK-1, type I transmembrane receptor (seizure related protein) and type I transmembrane receptor (seizure-related protein). (Genomic Genbank Accession no. NC_000016.8 GI:51511732; Region: complement (29,790,329-29,818,074); GenomeProject:168; Ensembl: ENSG00000174938) (SEQ. ID. No. 66).

ASPHD1 (mRNA Genbank Accession No. NM_181718.3) is aspartate beta-hydroxylase domain containing protein 1. (Genomic Genbank Accession no. NC_000016.8 GI:51511732; Region: complement (29,819, 648-29,824,878); GenomeProject: 168; Ensembl: ENSG00000174939) (SEQ. ID. No. 67).

KCTD13 (mRNA Genbank Accession No. NM_178863.2) is potassium channel tetramerisation domain containing protein 13. It is also known as FKSG86, PDIP1, POLDIP1, TNFAIP1-like and polymerase delta-interacting protein 1 (Genomic Genbank Accession no. NC_000016.8 GI:51511732; Region: complement (29,825,164-29,845,046); GenomeProject:168; Ensembl: ENSG00000174943) (SEQ. ID. No. 68).

LOC124446 (mRNA Genbank Accession No. NM_001083613.1; NM_194280.3) is TMEM219 or transmembrane protein 219. (Genomic Genbank Accession no. NC_000016.8 GI:51511732; Region: complement (29,880,852-29,891,874); GenomeProject: 168; Ensembl: ENSG00000149932) (SEQ. ID. No. 69).

HIRIP3 (mRNA Genbank Accession No. NM_003609.2) is HIRA interacting protein 3. The HIRA protein shares sequence similarity with Hir1p and Hir2p, the two corepressors of histone gene transcription characterized in the yeast, Saccharomyces cerevisiae. The structural features of the HIRA protein suggest that it may function as part of a multiprotein complex. Recently, several cDNAs encoding HIRA-interacting proteins, or HIRIPs, have been identified. In vitro, the HIRIP3 gene product binds HIRA, as well as H2B and H3 core histones, indicating that a complex containing HIRA-HIRIP3 could function in some aspects of chromatin and histone metabolism. (Genomic Genbank Accession no. NC_000016.8 GI:51511732; Region: complement (29,911,817-29,914,888); GenomeProject: 168; Ensembl: ENSG00000149929) (SEQ. ID. No. 70).

CCDC95 (mRNA Genbank Accession No. NM_173618.1) is coiled-coil domain containing 95. It is also known as INO80E, INO80 complex subunit E, FLJ00079 and FLJ90652. (Genomic Genbank Accession no. NC_000016.8 GI:51511732; Region: complement (29,915,032-29,924,613); GenomeProject:168; Ensembl: ENSG00000169592) (SEQ. ID. No. 71).

DOC2A (mRNA Genbank Accession No. NM_003586.2) is double C2-like domains protein, alpha. DOC2A is mainly expressed in brain and is suggested to be involved in Ca($^{2+}$)-dependent neurotransmitter release. (Genomic Genbank Accession no. NC_000016.8 GI:51511732; Region: complement (29,924,336-29,929,902); GenomeProject:168; Ensembl: ENSG00000149927) (SEQ. ID. No. 72).

FAM57B (mRNA Genbank Accession No. NM_031478.4) is family with sequence similarity 57 protein member B. It is also known as DKFZp43412117, FP1188, and hypothetical protein LOC83723. (Genomic Genbank Accession no. NC_000016.8 GI:51511732; Region: complement 29,943,249-29,949,687); GenomeProject: 168; Ensembl: ENSG00000149926) (SEQ. ID. No. 73).

ALDOA (mRNA Genbank Accession No. NM_000034.2; NM_001127617.1; NM_184041.1; NM_184043.1) is aldolase A or fructose-bisphosphate. It is a glycolytic enzyme that catalyzes the reversible conversion of fructose-1,6-bisphosphate to glyceraldehyde 3-phosphate and dihydroxyacetone phosphate. Three aldolase isozymes (A, B, and C), encoded by three different genes, are differentially expressed during development. Aldolase A is found in the developing embryo and is produced in even greater amounts in adult muscle. Aldolase A expression is repressed in adult liver, kidney and intestine and similar to aldolase C levels in brain and other nervous tissue. Aldolase A deficiency has been associated with myopathy and hemolytic anemia. Alternative splicing of this gene results in multiple transcript variants which encode the same protein. It is also known as ALDA, MGC10942, MGC17716, MGC17767, aldolase A, fructose-1,6-bisphosphate triosephosphate-lyase and fructose-bisphosphate aldolase A. (Genomic Genbank Accession no. NC_000016.8 GI:51511732; Region: complement (29,971,992-29,989,236); GenomeProject:168; Ensembl: ENSG00000149925) (SEQ. ID. No. 74).

PPP4C (mRNA Genbank Accession No. NM_002720.1) is protein phosphatase 4 (formerly X), catalytic subunit. It is also known as PP4, PPH3, and PPX. (Genomic Genbank Accession no. NC_000016.8 GI:51511732; Region: complement (29,994,886-30,004,196); GenomeProject:168; Ensembl: ENSG00000149923) (SEQ. ID. No. 75).

YPEL3 (mRNA Genbank Accession No. NM_031477.4) is yippee-like 3 protein is a putative zinc-binding protein. (Genomic Genbank Accession no. NC_000016.8 GI:51511732; Region: complement (30,011,136-30,015,022); GenomeProject: 168; Ensembl: ENSG00000090238) (SEQ. ID. No. 76).

GDPD3 (mRNA Genbank Accession No. NM_024307.2) is glycerophosphodiester phosphodiesterase domain containing protein 3. It is also known as FLJ22603 and MGC4171. (Genomic Genbank Accession no. NC_000016.8 GI:51511732; Region: complement (30,023,632-30,032,379); GenomeProject: 168; Ensembl: ENSG00000102886) (SEQ. ID. No. 77).

MAPK3 (mRNA Genbank Accession No. NM_001040056.1; NM_001109891.1; NM_002746.2) is mitogen-activated protein kinase 3. MAP kinases, also known as extracellular signal-regulated kinases (ERKs), act in a signaling cascade that regulates various cellular processes such as proliferation, differentiation, and cell cycle progression in response to a variety of extracellular signals. This kinase is activated by upstream kinases, resulting in its translocation to the nucleus where it phosphorylates nuclear targets. Alternatively spliced transcript variants encoding different protein isoforms have been described. It is also known as ERK1, HS44 KDAP, HUMKER1A, MGC20180, P44ERK1, P44MAPK, PRKM3, OTTHUMP00000174538, OTTHUMP0000174540, extracellular signal-regulated kinase 1 and extracellular signal-related kinase 1. (Genomic Genbank Accession no. NC_000016.8 GI:51511732; Region: complement (30,032,927-30,042,131); GenomeProject: 168; Ensembl: ENSG00000102882) (SEQ. ID. No. 78).

CORO1A (mRNA Genbank Accession No. NM_007074.2) is coronin, an actin binding protein, 1A. It is also known as CLABP, CLIPINA, FLJ41407, HCORO1, MGC117380, TACO, p57, and coronin-1. (Genomic Genbank Accession no. NC_000016.8 GI:51511732; Region: complement (30,102,427-30,107,898); GenomeProject: 168; Ensembl: ENSG00000102879) (SEQ. ID. No. 79).

In one embodiment, the method for diagnosing ASD and/or autism and/or predicting susceptibility or likelihood of developing ASD and/or autism comprises detecting the presence of a microdeletion or a microduplication in a region 29,581,801-29,589,329 on chromosome 16. (Genbank Accession no. NC_000016.8, GI:51511732; Region: 29,581,801-29,589,329; GenomeProject: 168; Ensembl:ENSG00000197471).

In one embodiment the method for diagnosing ASD and/or autism and/or predicting susceptibility or likelihood of developing ASD and/or autism comprises detecting the presence of a microdeletion or a microduplication in a region 29,582,081 to 29,589,324 on chromosome 16 according to the Human Genome Build 18 (Hg 18).

In one embodiment, the method for diagnosing ASD and/or autism and/or predicting susceptibility or likelihood of developing ASD and/or autism comprises detecting the presence of a microdeletion or a microduplication in a region 29725356-29730005 on chromosome 16. (Genbank Accession no. NC_000016.8 GI:51511732; Region: 29,725,356-29,730,005; GenomeProject: 168; Ensembl:ENSG00000103495).

In one embodiment, the method for diagnosing ASD and/or autism and/or predicting susceptibility or likelihood of developing ASD and/or autism comprises detecting the presence of a microdeletion or a microduplication in a region 29,892,723-29,911,082 on chromosome 16. (Genbank Accession no. NC_000016.8 GI:51511732; Region: 29,892,723-29,911,082; GenomeProject: 168; Ensembl:ENSG00000149930).

In one embodiment, the method for diagnosing ASD and/or autism and/or predicting susceptibility or likelihood of developing ASD and/or autism comprises detecting the presence of a microdeletion or microduplication in a region 29,899,174 to 29,907,220 on chromosome 16 according to the Human Genome Build 18 (Hg 18).

In one embodiment, the method for diagnosing ASD and/or autism and/or predicting susceptibility or likelihood of developing ASD and/or autism comprises detecting the presence of a microdeletion or a microduplication in a region 30,004,583-30,010,709 on chromosome 16. (Genbank Accession no. NC_000016.8 GI:51511732; Region: complement (30004583-30010709); GenomeProject: 168; Ensembl: ENSG00000149922).

In one embodiment, the method for diagnosing ASD and/or autism and/or predicting susceptibility or likelihood of developing ASD and/or autism comprises detecting the presence of a microdeletion or a microduplication in a region 29,560,500 to 30,106,852 on chromosome 16 according to the Human Genome Build 18 (Hg 18).

In one embodiment, the method for diagnosing ASD and/or autism and/or predicting susceptibility or likelihood of developing ASD and/or autism comprises detecting the presence of a microdeletion or a microduplication in a region 29,362,092-33,255,393 on chromosome 16 according to the Human Genome Build 18 (Hg 18).

In one embodiment, the method for diagnosing ASD and/or autism and/or predicting susceptibility or likelihood of developing ASD and/or autism comprises detecting the presence of a microdeletion or a microduplication in a region 29,581,455 to 30,027,260 on chromosome 16 according to the Human Genome Build 18 (Hg 18).

In one embodiment, the method for diagnosing ASD and/or autism and/or predicting susceptibility or likelihood of developing ASD and/or autism comprises detecting the presence of a microdeletion or a microduplication in the region 29,560,500 to 30,104,842 on chromosome 16 according to the Human Genome Build 18 (Hg 18).

In one embodiment, the method for diagnosing ASD and/or autism and/or predicting susceptibility or likelihood of developing ASD and/or autism comprises detecting the presence of a microdeletion or a microduplication in a region 29,560,500 to 30,104,842 on chromosome 16 according to the Human Genome Build 18 (Hg 18).

In one embodiment, the method for diagnosing ASD and/or autism and/or predicting susceptibility or likelihood of developing ASD and/or autism comprises detecting the presence of a microdeletion or a microduplication in a region 29,362,092 to 30,015,022 on chromosome 16 according to the Human Genome Build 18 (Hg 18).

In one embodiment, the method for diagnosing ASD and/or autism and/or predicting susceptibility or likelihood of developing ASD and/or autism comprises detecting the presence of a microdeletion or a microduplication in a region 29,581,455 to 30,240,082 on chromosome 16 according to the Human Genome Build 18 (Hg 18).

In one embodiment, the method for diagnosing ASD and/or autism and/or predicting susceptibility or likelihood of developing ASD and/or autism comprises detecting the presence of a microdeletion or a microduplication in a region 29,560,500 to 30,255,393 on chromosome 16 according to the Human Genome Build 18 (Hg 18).

In one embodiment, the method for diagnosing ASD and/or autism and/or predicting susceptibility or likelihood of developing ASD and/or autism comprises detecting the deletion or the duplication of at least one, two, three, four, five, six, seven, eight, nine, ten, 11, 12, 13, 14, 15, 16, 17, 18, 19, 20, 21, 22, 23, 24, 25, 26, 27, or 28 of the genes selected from the group consisting of: BOLA2, GIYD1/2, SULTI1A3/4, SPN, QPRT, c16orf4, KIF22, MAZ, PRRT2, c16orf53, MVP, CDIPT, SEZ6L2, ASPHD1, KCTD13, LOC124446, HIRIP3, CCDC95, DOC2A, FAM57B, ALDOA, PPP4C, YPEL3, GDPD3, MAPK3, CORO1A, TAO K2, and TBX6.

In one embodiment, the method for diagnosing ASD and/or autism and/or predicting susceptibility or likelihood of developing ASD and/or autism comprises detecting a deletion or a duplication of at least one, two, three or four genes: SPN, MAZ, TAO K2 and TBX6. In one embodiment, the deletion or the duplication of any of these four genes is complete, wherein all the 3'UTR, 5'UTR, introns and exons in the genomic sequence are all deleted. In one embodiment, the deletion of any of these four genes is partial, wherein a portion of the genomic sequence comprising the 3'UTR, 5'UTR, introns and exons is deleted.

In one embodiment, the probes used in detecting the deletion or the duplication in the region 29,362,092-33,255,393 on chromosome 16p11.2 comprises sequences from SEQ. ID. Nos. 43-46 and 56-79. In one embodiment, the probes used consist of SEQ. ID. Nos. 43-46 and 56-79. In one embodiment, the probes used consist essentially of SEQ. ID. Nos. 43-46 and 56-79.

In one embodiment, the probes used in detecting the segmental duplication in the region 29,362,092-33,255,393 on chromosome 16p11.2 comprises sequences from SEQ. ID. Nos. 54 and 55. In one embodiment, the probes used consist of SEQ. ID. Nos. 54 and 55. In one embodiment, the probes used consist essentially of SEQ. ID. Nos. 54 and 55.

In one embodiment, provided herein is a method for diagnosing ASD and/or autism in an individual, the method comprising detecting a microduplication on chromosome 15q13.2q13.3 wherein the presence of an about 0.500 Mb or larger microduplication on chromosome 15q13.2q13.3 in the genome of the individual is indicative that the individual is likely affected with autism.

In one embodiment, the microduplication on chromosome 15q13.2q13.3 occurs between BP4-BP5 region. BP4-BP5 covers about 1.5 Mb (chr15:28.719-30.298 Mb) and comprises six protein-coding genes and one miRNA gene as indicated below. Smaller duplications are about 0.500 Mb (chr15: 28.902-29.404 Mb) and comprises MTMR15, MTMR10, TRPM1, and one miRNA gene (hsa-mir-211). The BP4-BP5 deletion and duplication events span CHRNA7, a candidate gene for seizures. The six reference genes are MTMR15, MTMR10, TRPM1, KLF13, OTUD7A and CHRNA7, and the miRNA gene is hsa-mir-211.

In one embodiment, the microduplication on chromosome 15q13.2q13.3, BP4-BP5 region is anywhere between about 0.500 Mb to about 2 Mb long. In one embodiment, the microduplication on chromosome 15q13.2q13.3, BP4-BP5 region is anywhere between 0.500 Mb to 2 Mb long.

In one embodiment, provided herein is a method for predicting susceptibility or likelihood of an individual in developing ASD and/or autism, the method comprising detecting a microduplication on chromosome 15q13.2q13.3, wherein the presence of an about 0.500 Mb or larger microduplication on chromosome 15q13.2q13.3 in the genome of the individual indicates that the individual is likely affected with autism.

In one embodiment, the microduplication at 15q13.2q13.3 BP4-BP5 region comprises at least one, two, three, four, five, six or seven of the genes selected from the group consisting of: MTMR15, MTMR10, TRPM1, KLF13, OTUD7A, CHRNA7 and miRNA gene (hsa- mir-211). A skilled artisan in the art will be able to design oligonucleotide probes for use in the various detection methods known in the art, e.g. FISH, MLPA, oligonucleotide-based array CGH, to detect the deletion of these genes in a nucleic acid sample, such as, a genomic DNA of the individual who is tested.

MTMR15 (mRNA Genbank Accession No. NM_014967) is myotubularin related protein 15. It is also known as DKFZp451H236, DKFZp686K16147, and KLAA1018. (Genbank Accession No. NC_000015.8 GI:51511731; Region: 28,983,421-29022600; GenomeProject:168; Ensembl:ENSG00000198690) (SEQ. ID. No. 47). This gene can be found on Chromosome 15 at location 28,983,399-29,022,600. The start of this gene is located in Contig AC087481.9.1.179400.

MTMR10 (mRNA Genbank Accession No. NM_017762) is myotubularin related protein 10. It is also known as FLJ20313. (Genbank Accession no. NC_000015.8 GI:51511731; Region: complement (29,018,436-29,071,099); GenomeProject: 168; Ensembl:ENSG00000166912) (SEQ. ID. No. 48). This gene can be found on Chromosome 15 at location 29,020,705-29,071,099. The start of this gene is located in Contig AC090829.3.1.102926.

TRPM1 (mRNA Genbank Accession No. NM_002420) is transient receptor potential cation channel, subfamily M, member 1. It is also known as MLSN1 and LTRPC1. (Genbank Accession no. NC_000015.8 GI:51511731; Region: complement (29,080,829-29,181,216); GenomeProject:168; Ensembl:ENSG00000134160) (SEQ. ID. No. 49). The protein encoded by this gene is similar to the transient receptor potential (Trp) calcium channel family members. The expression of this protein is inversely correlated with melanoma aggressiveness, suggesting that it suppresses melanoma metastasis. This gene can be found on Chromosome 15 at location 29,080,845-29,181,216. The start of this gene is located in Contig AC009562.9.1.221475.

KLF13 (mRNA Genbank Accession No. NM_015995.2) is Kruppel-like factor 13. It is also known as BTEB3, FKLF2, NSLP1, RFLAT-1, RFLAT1, RANTES factor of late activated T lymphocytes-1, Sp1 like zinc finger transcription factor, basic transcription element binding protein 3, and transcription factor NSLP1. (Genbank Accession No. NC_000015.8 GI:51511731; Region: 29,406,375-29,457,394; GenomeProject: 168; Ensembl:ENSG00000169926) (SEQ. ID. No. 50). KLF13 belongs to a family of transcription factors that contain 3 classical zinc finger DNA-binding domains which consists of a zinc atom tetrahedrally coordinated by 2 cysteines and 2 histidines (C2H2 motif). These transcription factors bind to GC-rich sequences and related GT and CACCC boxes. This gene can be found on Chromosome 15 at location 29,406,375-29,457,393. The start of this gene is located in Contig AC012236.12.1.173729.

OTUD7A (mRNA Genbank Accession No. NM_130901) is OTU domain containing 7A. It is also known as OTUD7, C15orf16, C16ORF15, and CEZANNE2. (Genbank Accession No. NC_000015.8 GI:51511731; Region: complement (29,562,621-29,734,834); GenomeProject:168; Ensembl:ENSG00000169918) (SEQ. ID. No. 51). De-ubiquitinating enzymes (DUBs; see MIM 603478) are proteases that specifically cleave ubiquitin (MIM 191339) linkages, negating the action of ubiquitin ligases. OTUD7A belongs to a DUB subfamily characterized by an ovarian tumor (OTU) domain. This gene can be found on Chromosome 15 at location 29,562,621-29,734,834. The start of this gene is located in Contig AC104266.7.1.88425.

CHRNA7 (mRNA Genbank Accession No. NM_000746) is cholinergic receptor, nicotinic, alpha 7. It is also known as NACHRA7 or CHRNA7-2. (Genbank Accession No. NC_000015.8 GI:51511731; Region: 30,110,018-30,248,541; GenomeProject:168; Ensembl:ENSG00000175344) (SEQ. ID. No. 52). The nicotinic acetylcholine receptors (nAChRs) are members of a superfamily of ligand-gated ion channels that mediate fast signal transmission at synapses. The nAChRs are thought to be hetero-pentamers composed of homologous subunits. The proposed structure for each subunit is a conserved N-terminal extracellular domain followed by three conserved transmembrane domains, a variable cytoplasmic loop, a fourth conserved transmembrane domain, and a short C-terminal extracellular region. The protein encoded by this gene forms a homo-oligomeric channel, displays marked permeability to calcium ions and is a major component of brain nicotinic receptors that are blocked by, and highly sensitive to, alpha-bungarotoxin. This gene can be found on Chromosome 15 at location 30,110,018-30,249,002. The start of this gene is located in Contig AC079969.5.1.227506.

hsa-mir-211 (Genbank Accession No. AF071787) is a micro RNA (miRNA) gene (miRBase Accession No. MI0000287; Genbank Accession no. NC_000016.8 GI:51511732; 29,142,527-29,146,636; GenomeProject:168) (SEQ. ID. No. 53). Chromosome 15, Region: 29,142,527-29,146,636; Ensembl *Homo sapien* version 50.361; NCBI 36.

In one embodiment, the method for diagnosing ASD and/or autism, and/or predicting susceptibility or likelihood of an individual developing ASD and/or autism, comprises detecting the presence of a microduplication in a region 28,719,136-30,701,432 on chromosome 15 according to the Human Genome Build 18 (Hg 18).

In one embodiment, the method for diagnosing ASD and/or autism, and/or predicting susceptibility or likelihood of an individual developing ASD and/or autism, comprises detecting the presence of a microduplication in a region 28,719,136-30,648,918 on chromosome 15 according to the Human Genome Build 18 (Hg 18).

In one embodiment, the method for diagnosing ASD and/or autism, and/or predicting susceptibility or likelihood of an individual developing ASD and/or autism, comprises detecting the presence of a microduplication in a region 28,902,339-29,404,603 on chromosome 15 according to the Human Genome Build 18 (Hg 18).

In one embodiment, the method for diagnosing ASD and/or autism, and/or predicting susceptibility or likelihood of an individual developing ASD and/or autism, comprises detecting the presence of a microduplication in a region 28,983,399-29,022,600 on chromosome 15 according to the Human Genome Build 18 (Hg 18).

In one embodiment, the method for diagnosing ASD and/or autism, and/or predicting susceptibility or likelihood of an individual developing ASD and/or autism, comprises detecting the presence of a microduplication in a region 28,983,421 to 28,991,134 on chromosome 15 according to the Human Genome Build 18 (Hg 18).

In one embodiment, the method for diagnosing ASD and/or autism, and/or predicting susceptibility or likelihood of an individual developing ASD and/or autism, comprises detecting the presence of a microduplication in a region 29,018,436-29,071,099 on chromosome 15 according to the Human Genome Build 18 (Hg 18).

In one embodiment, the method for diagnosing ASD and/or autism, and/or predicting susceptibility or likelihood of an individual developing ASD and/or autism, comprises detecting the presence of a microduplication in a region 29,080,829-29,181,216 on chromosome 15 according to the Human Genome Build 18 (Hg 18).

In one embodiment, the method for diagnosing ASD and/or autism, and/or predicting susceptibility or likelihood of an individual developing ASD and/or autism, comprises detecting the presence of a microduplication in a region 29,080,843 to 29,181,216 on chromosome 15 according to the Human Genome Build 18 (Hg 18).

In one embodiment, the method for diagnosing ASD and/or autism, and/or predicting susceptibility or likelihood of an individual developing ASD and/or autism, comprises detecting the presence of a microduplication in a region 29,406,375-29,457,394 on chromosome 15 according to the Human Genome Build 18 (Hg 18).

In one embodiment, the method for diagnosing ASD and/or autism, and/or predicting susceptibility or likelihood of an individual developing ASD and/or autism, comprises detecting the presence of a microduplication in a region 29,562,621-29,734,834 on chromosome 15 according to the Human Genome Build 18 (Hg 18).

In one embodiment, the method for diagnosing ASD and/or autism, and/or predicting susceptibility or likelihood of an individual developing ASD and/or autism, comprises detecting the presence of a microduplication in a region 30,110,018-30,248,541 on chromosome 15 according to the Human Genome Build 18 (Hg 18).

In one embodiment, the method for diagnosing ASD and/or autism, and/or predicting susceptibility or likelihood of an individual developing ASD and/or autism, comprises detecting the presence of a microduplication in a region 30,110,018 to 30,248,527 on chromosome 15 according to the Human Genome Build 18 (Hg 18).

In one embodiment, the method for diagnosing ASD and/or autism, and/or predicting susceptibility or likelihood of an individual developing ASD and/or autism, comprises detecting the presence of a microduplication in a region 29,142,527-29,146,636 on chromosome 15 according to the Human Genome Build 18 (Hg 18).

In one embodiment, the method for diagnosing ASD and/or autism, and/or predicting susceptibility or likelihood of an individual developing ASD and/or autism, comprises detecting the presence of a microduplication in a region 29,080,829 to 29,181,199 on chromosome 15 according to the Human Genome Build 18 (Hg 18).

In one embodiment, the method for diagnosing ASD and/or autism, and/or predicting susceptibility or likelihood of an individual developing ASD and/or autism, comprises detecting a microduplication of all seven genes: MTMR15, MTMR10, TRPM1, KLF13, OTUD7A, CHRNA7 and miRNA gene hsa-mir-211. In one embodiment, the method for diagnosing ASD and/or autism, and/or predicting susceptibility or likelihood of an individual developing ASD and/or autism, comprises detecting a microduplication of at least one, two, three, four, five, six, or seven of the genes selected from the group consisting of: MTMR15, MTMR10, TRPM1, KLF13, OTUD7A, CHRNA7 and miRNA gene (hsa-mir-211). In one embodiment, the method for diagnosing ASD and/or autism, and/or predicting susceptibility or likelihood of an individual developing autism, comprises detecting a microduplication of four genes: MTMR15, MTMR10, TRPM1, and has-mir-211. In one embodiment, the microduplication of any of the seven genes is complete, wherein all the 3'UTR, 5'UTR, introns and exons in the genomic sequence are duplicated. In one embodiment, the microduplication of any of the seven genes is partial, wherein a portion of the genomic sequence comprising the 3'UTR, 5'UTR, introns and exons is duplicated.

In one embodiment, the probes used in detecting the microduplication in region 28,719,136-30,701,432 on chromosome 15 comprise sequences from SEQ. ID. Nos. 47-53.

In one embodiment, the probes used in detecting the microduplication in region 28,719,136-30,701,432 on chromosome 15 consist of SEQ. ID. Nos. 47-53.

In one embodiment, the probes used in detecting the microduplication in region 28,719,136-30,701,432 on chromosome 15 consist essentially of SEQ. ID. Nos. 47-53.

In another embodiment, provided herein method for diagnosing ASD and/or autism in an individual, the method comprising detecting a microdeletion on chromosome 15q13.2q13.3 wherein the presence of an about 0.500 Mb or larger microdeletion on chromosome 15q13.2q13.3 in the genome of the individual is indicative that the individual is likely affected with autism.

In one embodiment, the microdeletion on chromosome 15q13.2q13.3 occurs between BP4-BP5 region.

In one embodiment, the microdeletion on chromosome 15q13.2q13.3, BP4-BP5 region is between about 0.500 Mb to about 2 Mb long. In one embodiment, the microdeletion on chromosome 15q13.2q13.3, BP4-BP5 region is between 0.500 Mb to 2 Mb long.

In one embodiment, provided herein is a method for predicting susceptibility or likelihood of an individual in developing ASD and/or autism, the method comprising detecting a microdeletion on chromosome 15q13.2q13.3, wherein the presence of an about 0.500 Mb or more microdeletion on chromosome 15q13.2q13.3 in the genome of the individual is indicative that the individual is susceptibility or likely to be affected with autism.

In one embodiment, the microdeletion at 15q13.2q13.3 BP4-BP5 region at least one, two, three, four, five, six or seven of the genes selected from the group consisting of: MTMR15, MTMR10, TRPM1, KLF13, OTUD7A CHRNA7 and miRNA gene, hsa-mir-211. A skilled artisan in the art will be able to design oligonucleotide probes for use in the various detection methods known in the art, e.g. FISH, MLPA, oligonucleotide-based array CGH, to detect the deletion of these genes in a nucleic acid sample, such as, a genomic DNA of the individual who is being tested.

In one embodiment, the method for diagnosing ASD and/or autism, and/or predicting susceptibility or likelihood of an individual developing ASD and/or autism, comprises detecting the presence of a microdeletion in a region 28,709,202-30,401,675 on chromosome 15 according to the Human Genome Build 18 (Hg 18).

In one embodiment, the method for diagnosing ASD and/or autism, and/or predicting susceptibility or likelihood of an individual developing ASD and/or autism, comprises detecting the presence of a microdeletion in a region 28,709,202-30,701,432 on chromosome 15 according to the Human Genome Build 18 (Hg 18).

In one embodiment, the method for diagnosing ASD and/or autism, and/or predicting susceptibility or likelihood of an individual developing ASD and/or autism, comprises detecting the microdeletion of all seven genes: MTMR15, MTMR10, TRPM1, KLF13, OTUD7A, CHRNA7 and miRNA gene (hsa-mir-211). In one embodiment, the method for diagnosing ASD and/or autism, and/or predicting susceptibility or likelihood of an individual developing ASD and/or autism, comprises detecting the microduplication of four genes: MTMR15, MTMR10, TRPM1, and has-mir-211. In one embodiment, the method for diagnosing ASD and/or autism, and/or predicting susceptibility or likelihood of an individual developing ASD and/or autism, comprises detecting the microdeletion of at least one, two, three, four, five, six, or seven of the genes selected from the group consisting of: MTMR15, MTMR10, TRPM1, KLF13, OTUD7A, CHRNA7 and miRNA gene (hsa-mir-211). In one embodiment, the microdeletion of any of the seven genes is complete, wherein all the 3'UTR, 5'UTR, introns and exons in the genomic sequence are deleted. In one embodiment, the microdeletion of any of the seven genes is partial, wherein a portion of the genomic sequence comprising the 3'UTR, 5'UTR, introns and exons is deleted.

In one embodiment, the probes used in detecting the microdeletion in region 28,709,202-30,401,675 on chromosome 15 comprise sequences from SEQ. ID. Nos. 47-53.

In one embodiment, the probes used in detecting the microdeletion in region 28,709,202-30,401,675 on chromosome 15 consist of SEQ. ID. Nos. 47-53.

In one embodiment, the probes used in detecting the microdeletion in region 28,709,202-30,401,675 on chromosome 15 consist essentially of SEQ. ID. Nos. 47-53.

In some embodiments, the methods described herein are conducted using nucleic acid samples isolated from the individuals. The individuals are humans, adults, children, or fetus. The nucleic acid samples can be isolated from cells obtained from the individuals. For example, fetal cells obtained in routine amniocentesis conducted from 10 weeks of gestation onwards; cells from a newly born infant can be obtained from the umbilical cord blood, placenta, or a blood sample; for older children and individuals, cells can be obtained from a blood sample or a cheek swab. Genomic DNA can be extracted from any biological sample containing nucleated cells, such as a peripheral blood sample or a tissue sample (e.g., mucosal scrapings of the lining of the mouth or from renal or hepatic tissue). One ordinary skilled in the art will be able to isolate nucleic acid samples from the individuals from various sources. Standard methods can be used to extract genomic DNA from a blood or tissue sample, including, for example, phenol extraction. Alternatively, genomic DNA can be extracted with kits such as the QIAAMP® Tissue Kit (QIAGEN®, Valencia, Calif.), WIZARD® Genomic DNA purification kit (Promega, Madison, Wis.) and the A.S.A.P.™ Genomic DNA isolation kit (Boehringer Mannheim, Indianapolis, Ind.).

In one embodiment, the nucleic acid sample isolated from an individual is genomic DNA. In one embodiment, genomic DNA is digested by restriction enzymes. In one embodiment, genomic DNA is labeled. Suitable labels, include, for example, radioisotopes (e.g., $^{125}$I, $^{131}$I, $^{35}$S, $^{3}$H, $^{32}$P, $^{33}$P, or $^{14}$C), fluorescent moieties (e.g., fluorescein, carboxyfluorescein, fluorescein-5-isothiocyanate (FITC), PerCP, rhodamine, or phycoerythrin (PE)), luminescent moieties (e.g., QDOT™ nanoparticles supplied by the Quantum Dot Corporation, Palo Alto, Calif.), or compounds that absorb light of a defined wavelength. Methods of detecting or quantifying a label depend on the nature of the label and these methods are known in the art. Examples of detectors include, without limitation, x-ray film, radioactivity counters, scintillation counters, spectrophotometers, calorimeters, fluorometers, luminometers, and densitometers.

In some embodiments, the labeled genomic DNA is hybridized the BAC-based array chips and/or oligonucleotide-based array chips in comparative genomic hybridization (CGH) to detect the presence of the described microdeletions and/or microduplications herein.

In some embodiments, the methods described herein are conducted in individuals with no family history of ASD and/or autism. In some embodiments, the methods described herein are conducted in individuals with a family history of autism. For example, individuals with at least one direct sibling who is diagnosed with ASD and/or autism or a relative in the extended family who is diagnosed with ASD and/or autism.

In one embodiment, the individual does not have any problems or symptoms in social skills, language and behavior that are associated with ASD and/or autism at the time of testing or when the methods described herein is performed for that individual.

In another embodiment, the individual can be beginning to show problems or symptoms in social skills, language and behavior that are associated with ASD and/or autism. The teacher, clinician, friends, parents and/or psychologist have noticed some problems or symptoms in social skills, language and behavior in the child and have recommended the child be evaluated for ASD and/or autism. In social interactions and relationships, symptoms can include those described herein according to DSM-IV: significant problems developing nonverbal communication skills, such as eye-to-eye gazing, facial expressions, and body posture; failure to establish friendships with children the same age; lack of interest in sharing enjoyment, interests, or achievements with other people; lack of empathy. People with ASD and/or autism can have difficulty understanding another person's feelings, such as pain or sorrow. In verbal and nonverbal communication, symptoms can include those described herein according to DSM-UV: delay in, or lack of, learning to talk. As many as 50% of people with ASD and/or autism never speak; problems taking steps to start a conversation. Also, people with ASD and/or autism have difficulties continuing a conversation once it has begun; stereotyped and repetitive use of language. People with ASD and/or autism often repeat over and over a phrase they have heard previously (echolalia). Autistic individuals have difficulty understanding their listener's perspective. For example, a person with autism may not understand that someone is using humor. They may interpret the communication word for word and fail to catch the implied meaning. In limited interests in activities or play, symptoms can include: an unusual focus on pieces. Younger children with autism often focus on parts of toys, such as the wheels on a car, rather than playing with the entire toy or are preoccupation with certain topics. For example, older children and adults may be fascinated by train schedules, weather patterns, or license plates. A need for sameness and routines. For example, a child with autism may always need to eat bread before salad and insist on driving the same route every day to school. Stereotyped behaviors. These can include body rocking and hand flapping.

In yet another embodiment, the individual has been diagnosed with ASD and/or autism using symptomatic diagnostic criteria as described herein, e.g. in DSM-IV.

In some embodiments, the microdeletion and/or microduplications described herein are be detected by any DNA, RNA (e.g., Northern blotting), or protein (e.g., Western blotting or protein activity) based method. Non-limiting examples of DNA based methods include quantitative PCR; fluorescence in situ hybridization (FISH); Southern blotting; multiple amplifiable probe hybridization (MAPF, see Hollox et al., 2002, Expert Rev. Mol. Diagn., 2(4):370-8.); multiplex ligation-dependent probe amplification (MLPA, see Schouten et al., 2002, Nucleic Acids Res., 30(12):e57, kits available from MRC-Holland, Amsterdam, The Netherlands); QMPSF (Quantitative Multiplex PCR of Short Fluorescent Fragments, see Casilli et al., 2002, Hum. Mutat. 20(3):218-26), and combinations or modifications of such methods. These methods are well known in the art and one of ordinary skill in the art can perform the analyses using the genomic DNA isolated from the individual.

In one embodiment, the detection of the microdeletion and/or microduplication in the methods described herein is by multiplex ligation-dependent probe amplification (MLPA) analysis.

MLPA is a method to establish the copy number of up to 45 nucleic acid sequences in one single PCR amplification reaction. It can be applied on genomic DNA (both copy number detection and methylation quantification) as well as for mRNA profiling. It has been accepted as a simple and reliable method for multiplex detection of copy number changes of genomic DNA sequences using DNA samples derived from blood (Gille, J. J., et al. (2002), Br. J. Cancer, 87, 892-897; Hogervorst, F. B., et al. (2003) Cancer Res., 63, 1449-1453).

With MLPA, it is possible to perform a multiplex PCR reaction in which up to 45 specific sequences are simultaneously quantified. Amplification products are separated by sequence type electrophoresis. The peaks obtained in the sequence type electrophoresis, when compared with a control sample peak, allows one to determine the gene copy number of a probed gene or nucleic acid sequence in the test sample. As only one pair of PCR primers is used, MLPA reactions result in a very reproducible gel pattern with fragments ranging from 130 to 490 bp. Comparison of this gel pattern to that obtained with a control sample indicates which sequences show an aberrant copy number.

Figure 6:
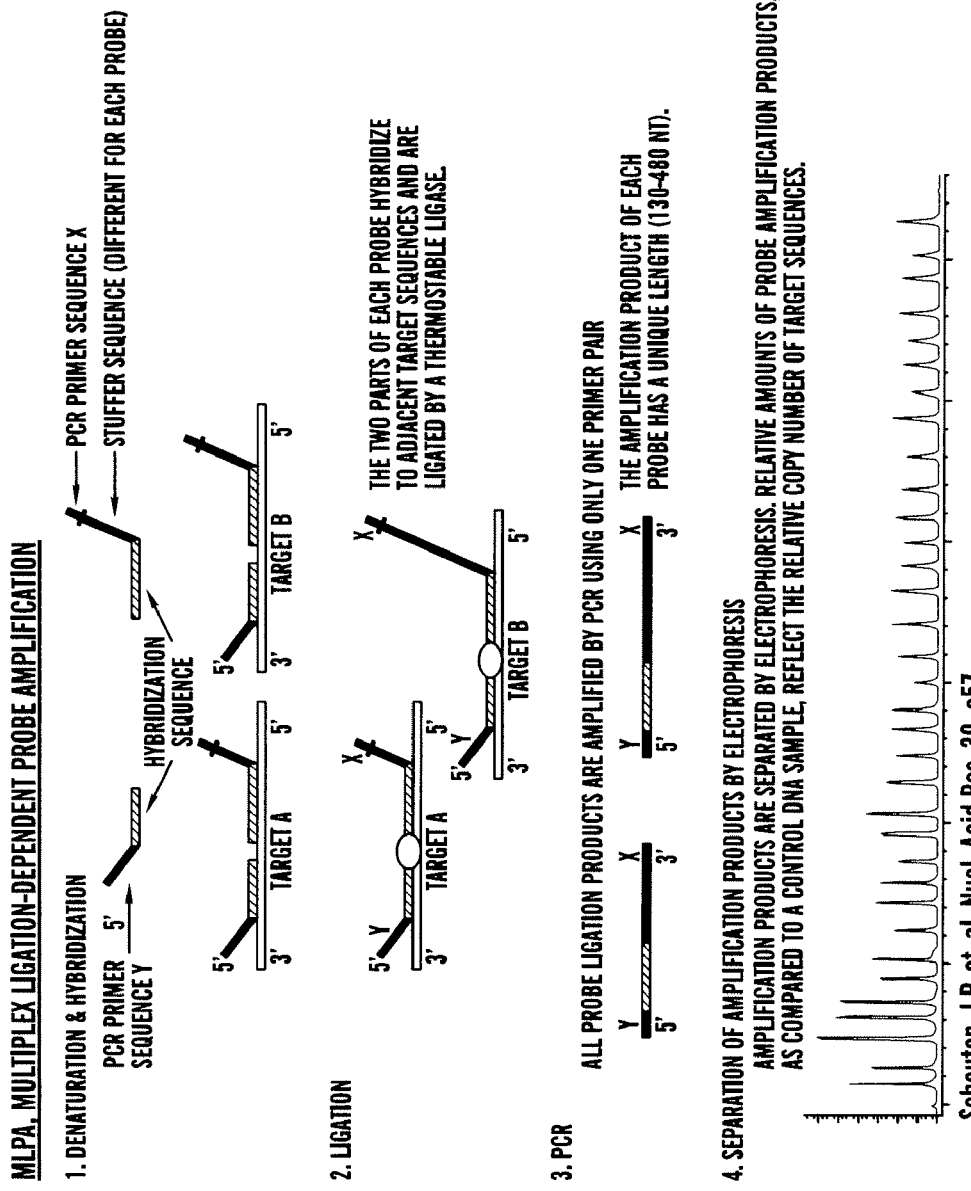
FIG. 6 shows a brief outline of multiplex ligation-dependent probe amplification (MLPA) assay.

The general outline of MLPA is shown in FIG. 6 and fully described in Schouten, J. P. et al., (2002) Nucl. Acid Res. 30, e57. MLPA probes are designed that hybridizes to the gene of interest or region of genomic DNA that have variable copies or polymorphism. Each probe is actually in two parts, both of which will hybridize to the target DNA in close proximity to each other. Each part of the probe carries the sequence for one of the PCR primers. Only when the two parts of the MLPA probe are hybridize to the target DNA in close proximity to each other will the two parts be ligated together, and thus form a complete DNA template for the one pair of PCR primers used. When there are microdeletions, the provided MLPA probes that targets the deletion region will not form complete DNA template for the one pair of PCR primers used and so no or lower amount of PCR products will be formed. When there are microduplications, the provided MLPA probes that targets the duplicated region will form many complete DNA templates for the one pair of PCR primers used compared to a normal copy number sample of genomic DNA. The amount of PCR products formed will be more than in a control sample having a normal copy number of the region of interest.

MLPA probes are able to discriminate between sequences that differ in only one nucleotide. Moreover, MLPA reactions require a minimum of only 20 ng human DNA. In contrast to e.g. FISH and BAC-arrays, the sequences detected are small (about 60 nucleotides). Compared to other techniques, an MLPA reaction is fast, cheap (EUR 12, per reaction) and very simple to perform. The equipment required is present in most molecular biology laboratories: Thermocycler with heated lid and sequence type electrophoresis equipment.

The general protocol for MLPA is described in Schouten, J. P. et al., (2002) Nucl. Acid Res. 30, e57, on the world wide web at www "dot" mlpa "dot" com and also can be found U.S. Pat. No. 6,955,901, these references are incorporated herein by reference in their entirety.

To screen for the microdeletion/microduplication and/or segmental duplications in the 16p11.2 region, four pairs of MLPA target-probes are designed based on the unique sequences of four genes within this interval: SPN, AMZ, TAOK and TBX6. Additionally, four pairs of MLPA control probes are included, two pairs corresponding to unique sequences of SEPT1 and LAT genes located on chromosome 16 outside the deletion interval, and two pairs corresponding to unique sequences on other chromosomes. All probes were synthetic oligonucleotides. MLPA reagents are commercially available. Final PCR products can be analyzed on an Applied Biosystems Inc. ABI 3730XL for peak identification and quantification. Copy number alterations were visually inspected by superimposing the peak profile of a test sample with the profile of a normal sample using SoftGenetics GENEMARKER software. For actual copy number quantification, the peak areas can be exported to a Microsoft Excel worksheet. Peak area for each probe are normalized to the mean value for all control probes. The relative ratio of each peak are calculated by comparing between test sample and normal sample. Deletion are identified as relative ratio<0.75 and duplication as relative ratio>1.25.

In some embodiments, the MLPA target-probes used in the methods described herein are MLPA probes for the 16p11.2 region: GCTTCTCCTTCTCCTTGGGGTGCTGGTG (SEQ. ID No 25), GTAAGCCCAGACGCTCTGGGGAG-CACAAC (SEQ. ID No 26), GACACGAGGAGAAAGT-GCCATGTCACGTGT (SEQ. ID No 27), GTGGCAAGAT-GCTGAGCTCGGCTTATATTTCG (SEQ. ID No 28), GCTGGACAACCTGCAGTACCGCAAGATGAAG (SEQ. ID No 29), AAGATCCTGTTCCAAGAGGCACCCAACG-GCCCTGG (SEQ. ID No 30), GTCAGTCACTGGCCTG-GACCCCGAGGCCCGCTACTTGTTT (SEQ. ID No 31), and CTTCTGGATGTGATTCCGGTGGATGGGGCTCG (SEQ. ID No 32).

In some embodiments, the MLPA target-probes used in the methods described herein are MLPA probes for the 15q13.2q13.3 BP4-BP5 deletion/duplication region:

```
                                          (SEQ. ID No 5)
CAATGACTCGCAACCACTCACCGTCTACTTCTC, (SEQ. ID No 6)
CCTGAGCCTCCTGCAGATCATGGAC, (SEQ. ID No 9)
CACAGCCAATCTGCCACATGTGTTCAATGAAGGGCGG, (SEQ. ID No 10)
GGTCCCAAGCAGCCAGAGCGAGAGCCACAG, (SEQ. ID No 15)
GTGTTATCAGCCACGTAGGGGATGCCTTGAAAGACCACTCCTC, (SEQ. ID No 16)
CAAGTCCAGAGGCCGGGTTTGTGCTATAGGAATTG, (SEQ. ID No 17)
GGAGGTCAGGGACAGCTTTCAACAGTCCTGTTGGTCAA,
and (SEQ. ID No 18)
CCTCGGCCGAATGGAGTTTCCTAGTTACACCATCAATCGGAAAACC.
```

In one embodiment, these MLPA target-probes are synthetic oligonucleotides designed to incorporate the primer sequences for the MLPA amplification step as described by MRC-Holland, Amsterdam, The Netherlands.

In one embodiment, the detection of the microdeletion and/or microduplication in the methods described herein is by oligonucleotide-based array comparative genomic hybridization (oligonucleotide-based array CGH).

In one embodiment, the detection of the microdeletion and/or microduplication in the methods described herein is by bacterial artificial chromosome-based array comparative genomic hybridization (BAC-based array CGH).

CGH are methods of determining the relative number of copies of nucleic acid sequences in one or more subject's genomes or portions thereof (for example, a tumor cell) as a function of the location of those sequences in a reference genome (for example, a normal human genome, one who is not diagnosed with autism). The intensity(ies) of the signals from each labeled subject nucleic acid and/or the differences in the ratios between different signals from the labeled subject nucleic acid sequences are compared to determine the relative copy numbers of the nucleic acid sequences in the one or more subject genomes or portions thereof. In U.S. Pat. Nos. 5,721,098, 5,665,549, 5,856,097, 5,976,790, 6,159,685, and 6,335,167 describes CGH and uses. These patents are incorporated herein by reference in their entirety.

As classical CGH has an average resolution of 10-20 megabases (Mb), it is able to detect changes affecting relatively large chromosomal regions. The introduction of array-based platforms has therefore greatly improved genomic profiling and currently, two technologies are mainly used for screening of DNA copy number; the BAC (Bacterial Artificial Chromosome) and the oligonucleotide-based CGH arrays. BAC-based CGH arrays are amongst the first genomic arrays to be introduced and are routinely used to detect single copy changes in the genome, owing to their high sensitivity.

In BAC-based array CGH, the CGH array chip is made using BAC amplified genomic sequences. The first whole genome microarray contained 2400 large-insert genomic clones, primarily bacterial artificial chromosomes (BACs). With the total human genome covering 3000 Mb, the resolution of this array is on average close to 1 Mb, about one order of magnitude higher than that obtained with classical CGH. For a full coverage resolution array 30, 000 BACs have been arrayed, increasing the resolution with another order of magnitude.

In oligonucleotide-based array CGH, the chip is made using synthetic oligonucleic acid of about 60 mer of specific target genes and/or genomic region, and the resolution can be reduced to about 100 kb. In some embodiments, the oligonucleotide-based array CGH encompass array chip comprising synthetic oligonucleic acid of about 60 mer of BOLA2, GIYD1/2, SULTI1A3/4, SPN, QPRT, c16orf54, KIF22, MAZ, PRRT2, c16orf53, MVP, CDIPT, SEZ6L2, ASPHD1, KCTD13, LOC124446, HIRIP3, CCDC95, DOC2A, FAM57B, ALDOA, PPP4C, YPEL3, GDPD3, MAPK3, CORO1A, TAO K2, TBX6, MTMR15, MTMR10, TRPM1, KLF13, OTUD7A and CHRNA7. In other embodiments, the Human Release 2.0 oligonucleotide library, containing 60mer oligonucleotides representing 28 830 unique genes can be obtained from Sigma-Genosys (Zwijndrecht, The Netherlands) and used in making a custom autism oligonucleotide-based array CGH chip. The oligonucleotides are dissolved at 10 µM concentration in 50 mM sodium phosphate buffer pH 8.5 and single spotted onto CODELINK™ slides (Amersham Biosciences), using an OMNIGRID® 100 microarrayer (Genomic Solutions, Ann Arbor, Mich., USA) equipped with SMP3 pins (TeleChem International, Sunnyvale, Calif., USA). After printing slides are processed and blocked prior to use according to the manufacturer's protocol.

Array CGH chips are available commercially from two companies, AGILENT and NIMBLEGEN. Both companies specializes in oligonucleotide-based array CGH chips. Custom design chips are also available. BAC-based array CGH chips are available from PERKINELMER®. Other CGH reagents and DNA labeling kits are available from PERKINELMER® and INVITROGEN™, Inc.

In one embodiment, the detection of the microdeletion and/or microduplication in the methods described herein is by fluorescence in situ hybridization (FISH). One ordinary skilled in the art will be able to perform FISH on chromosomal samples derived from individuals according to known standard protocols, such as those described in U.S. Pat. Nos. 5,665,540, 6,242,184 and 7,087,379. These patents are incorporated herein by reference in their entirety.

In one embodiment, the MLPA probes shown in Table 12 are used in FISH. In another embodiment, the MLPA probes shown in Table 12 are modified such as labeling with fluorescent dyes or a radioisotope. Other suitable labels, include, for example, radioisotopes (e.g., $^{125}I$, $^{131}I$, $^{35}S$, $^{3}H$, $^{32}P$, $^{33}P$, or $^{14}C$), fluorescent moieties (e.g., fluorescein, carboxyfluorescein, fluorescein-5-isothiocyanate (FITC), PerCP, rhodamine, or phycoerythrin (PE)), luminescent moieties (e.g., QDOT™ nanoparticles supplied by the Quantum Dot Corporation, Palo Alto, Calif.), or compounds that absorb light of a defined wavelength. Methods of detecting or quantifying a label depend on the nature of the label and are known in the art. Examples of detectors include, without limitation, x-ray film, radioactivity counters, scintillation counters, spectrophotometers, calorimeters, fluorometers, luminometers, and densitometers.

Unless otherwise explained, all technical and scientific terms used herein have the same meaning as commonly understood by one of ordinary skill in the art to which this disclosure belongs. Definitions of common terms in molecular biology can be found in The Merck Manual of Diagnosis and Therapy, 18th Edition, published by Merck Research Laboratories, 2006 (ISBN 0-911910-18-2); Robert S. Porter et al. (eds.), The Encyclopedia of Molecular Biology, published by Blackwell Science Ltd., 1994 (ISBN 0-632-02182-9); and Robert A. Meyers (ed.), Molecular Biology and Biotechnology: a Comprehensive Desk Reference, published by VCH Publishers, Inc., 1995 (ISBN 1-56081-569-8); Definitions of common terms in molecular biology can also be found in Benjamin Lewin, Genes IX, published by Jones & Bartlett Publishing, 2007 (ISBN-13: 9780763740634); Kendrew et al. (eds.), The Encyclopedia of Molecular Biology, published by Blackwell Science Ltd., 1994 (ISBN 0-632-02182-9); and Robert A. Meyers (ed.), Molecular Biology and Biotechnology: a Comprehensive Desk Reference, published by VCH Publishers, Inc., 1995 (ISBN 1-56081-569-8).

Unless otherwise stated, the present invention was performed using standard procedures, as described, for example in Maniatis et al., Molecular Cloning: A Laboratory Manual, Cold Spring Harbor Laboratory Press, Cold Spring Harbor, N.Y., USA (1982); Sambrook et al., Molecular Cloning: A Laboratory Manual (2 ed.), Cold Spring Harbor Laboratory Press, Cold Spring Harbor, N.Y., USA (1989); Davis et al., Basic Methods in Molecular Biology, Elsevier Science Publishing, Inc., New York, USA (1986); Methods in Enzymology: Guide to Molecular Cloning Techniques Vol. 152, S. L. Berger and A. R. Kimmerl Eds., Academic Press Inc., San Diego, USA (1987); Current Protocols in Molecular Biology (CPMB) (Fred M. Ausubel, et al. ed., John Wiley and Sons, Inc.); Current Protocols in Protein Science (CPPS) (John E. Coligan, et. al., ed., John Wiley and Sons, Inc.); Current Protocols in Immunology (CPI) (John E. Coligan, et. al., ed. John Wiley and Sons, Inc.); and Current Protocols in Cell Biology (CPCB) (Juan S. Bonifacino et. al. ed., John Wiley and Sons, Inc.) which are all incorporated by reference herein in their entireties.

It should be understood that this invention is not limited to the particular methodology, protocols, and reagents, etc., described herein and as such can vary. The terminology used herein is for the purpose of describing particular embodiments only, and is not intended to limit the scope of the present invention, which is defined solely by the claims.

Other than in the operating examples, or where otherwise indicated, all numbers expressing quantities of ingredients or reaction conditions used herein should be understood as modified in all instances by the term "about."

The singular terms "a," "an," and "the" include plural referents unless context clearly indicates otherwise. Similarly, the word "or" is intended to include "and" unless the context clearly indicates otherwise. It is further to be understood that all base sizes or amino acid sizes, and all molecular weight or molecular mass values, given for nucleic acids or polypeptides are approximate, and are provided for description. Although methods and materials similar or equivalent to those described herein can be used in the practice or testing of this disclosure, suitable methods and materials are described below. The abbreviation, "e.g." is derived from the Latin exempli gratia, and is used herein to indicate a non-limiting example. Thus, the abbreviation "e.g." is synonymous with the term "for example."

All patents and other publications identified are expressly incorporated herein by reference for the purpose of describing and disclosing, for example, the methodologies described in such publications that might be used in connection with the present invention. These publications are provided solely for their disclosure prior to the filing date of the present application. Nothing in this regard should be construed as an admission that the inventors are not entitled to antedate such disclosure by virtue of prior invention or for any other reason. All statements as to the date or representation as to the contents of these documents is based on the information available to the applicants and does not constitute any admission as to the correctness of the dates or contents of these documents.

Definitions of Terms

As used herein, the term "autism", refers to autism spectrum disorder (ASD) which is also known as Pervasive Developmental Disorders (PDDs). Symptoms include difficulty in social skills, language and behavior. The term "autism" and autism spectrum disorder (ASD) are used interchangeably herein.

As used herein, the term "comprising" means that other elements can also be present in addition to the defined elements presented. The use of "comprising" indicates inclusion rather than limitation.

As used herein the term "consisting essentially of" refers to those elements required for a given embodiment. The term permits the presence of elements that do not materially affect the basic and novel or functional characteristic(s) of that embodiment of the invention.

The term "consisting of" refers to methods and respective components thereof as described herein, which are exclusive of any element not recited in that description of the embodiment.

The term "gene" means the nucleic acid sequence which is transcribed (DNA) and translated (mRNA) into a polypeptide in vitro or in vivo when operably linked to appropriate regulatory sequences. The gene may or may not include regions preceding and following the coding region, e.g. 5' untranslated (5'UTR) or "leader" sequences and 3' UTR or "trailer" sequences, as well as intervening sequences (introns) between individual coding segments (exons).

In the present invention, "isolated" refers to material removed from its original environment (e.g., the natural environment if it is naturally occurring), and thus is altered "by the hand of man" from its natural state. For example, an isolated nucleic acid from a cell which is substantially or essentially free from components which normally accompany or interact with the nucleic acid as found in the nucleus.

The term "nucleic acid" refers to deoxyribonucleotides or ribonucleotides and polymers thereof ("polynucleotides") in either single- or double-stranded form. Unless specifically limited, the term encompasses nucleic acids containing known analogues of natural nucleotides that have similar binding properties as the reference nucleic acid and are metabolized in a manner similar to naturally occurring nucleotides. Unless otherwise indicated, a particular nucleic acid molecule/polynucleotide also implicitly encompasses conservatively modified variants thereof (e.g. degenerate codon substitutions) and complementary sequences as well as the sequence explicitly indicated. Specifically, degenerate codon substitutions may be achieved by generating sequences in which the third position of one or more selected (or all) codons is substituted with mixed-base and/or deoxyinosine residues (Batzer et al., Nucleic Acid Res. 19: 5081 (1991); Ohtsuka et al., J. Biol. Chem. 260: 2605-2608 (1985); Rossolini et al., Mol. Cell. Probes 8: 91-98 (1994)). Nucleotides are indicated by their bases by the following standard abbreviations: adenine (A), cytosine (C), thymine (T), and guanine (G).

As used herein, the term "genomic DNA" refers to the DNA which is found in the organisms genome and is passed on to offspring as information necessary for survival. The "genomic DNA" is also the "nucleic acid" that is isolated from nucleated cells.

As used herein, the term "microdeletion" in the genomic DNA refers to absence of a stretch of DNA sequence that is normally found in the genome of a normal individual. The missing stretch of DNA sequence can range from 100 kb to 2 Mb. The loss of a tiny piece of a chromosome, a piece so small its presence is not apparent on ordinary examination (using a regular light microscope to look at chromosomes prepared in the usual fashion). The detection of microduplications requires special techniques such as high-resolution chromosome banding, molecular chromosome analysis (with FISH), or molecular genetic analysis.

As used herein, the term "microduplication" in the genomic DNA refers to the presence of extra copies of a stretch of DNA sequence that is normally found as single or limited copy in the genome of a normal individual. The gain of a tiny piece of a chromosome, a piece so small its presence is not apparent on ordinary examination (using a regular light microscope to look at chromosomes prepared in the usual fashion). The detection of microduplications typically requires special techniques such as high-resolution chromosome banding, molecular chromosome analysis (with FISH), or molecular genetic analysis. The term "microduplication" and "duplication" are used interchangeably herein.

As used herein, the term "segmental duplications" are substantially identical segments of DNA at two or more sites in a genome.

As used herein, a normal individual is one who has not diagnosed with autism, ASD, developmental delay or mental retardation.

Some embodiments of the present invention can be defined in any of the following alphabetized paragraphs. These embodiments should not be construed as limiting embodiments.

[A] A method for diagnosing an autism spectrum disorder in a human individual or a human fetus, the method comprising determining whether or not the human individual or the human fetus carries an about 500 kb long microdeletion or microduplication that is flanked by an about 100 kb to about 147 kb long segmental duplication on a chromosome 16p11.2 region between 29.5 Mb and 31.1 Mb, wherein the presence of an about 500 kb long microdeletion or microduplication that is flanked by an about 100 kb to about 147 kb long segmental duplication on the chromosome 16p11.2 region between 29.5 Mb and 31.1 Mb is indicative of diagnosis of the autism spectrum disorder in the human individual or the human fetus.

[B] The method of paragraph [A], wherein the microdeletion or microduplication comprises at least one gene selected from the group consisting of: BOLA2, GIYD1/2, SULTI1A3/4, SPN, QPRT, c16orf54, KIF22, MAZ, PRRT2, c16orf53, MVP, CDIPT, SEZ6L2, ASPHD1, KCTD13, LOC124446, HIRIP3, CCDC95, DOC2A, FAM57B, ALDOA, PPP4C, YPEL3, GDPD3, MAPK3, CORO1A, TAO K2, and TBX6.

[C] The method of paragraph [A], wherein the microdeletion or microduplication comprises SPN, MAZ, TAO K2, and TBX6 genes.

[D] The method of paragraph [A], wherein the segmental duplication is about 147 kb long.

[E] The method of paragraph [A], wherein the segmental duplication is SEQ. ID. No. 54 or 55.

[F] The method of paragraph [A], wherein the determination is performed using an oligonucleotide-based array comparative genomic hybridization (oligonucleotide-based CGH).

[G] The method of paragraph [A], wherein the determination is performed using a bacterial artificial chromosome-based array comparative genomic hybridization (BAC-based CGH).

[H] The method of paragraph [A], wherein the determination is performed using a fluorescence in situ hybridization (FISH).

[I] The method of paragraph [A], wherein the determination is performed using a multiplex ligation-dependent probe amplification (MLPA).

[J] A method for diagnosing an autism spectrum disorder in a human individual or a human fetus, the method comprising determining whether or not the human individual or the human fetus carries a between about 500 kb and about 2 Mb microduplication on chromosome 15q13.2q13.3 between a BP4 and a BP5 region, wherein presence of a between about 500 kb and about 2 Mb long microduplication on chromosome 15q13.2q13.3 between the BP4 and the BP5 region is indicative of diagnosis of the autism spectrum disorder in the human individual or the human fetus.

[K] The method of paragraph [J], wherein the microduplication is about 500 kb long.

[L] The method of claim [J], wherein the wherein the microdeletion comprises MTMR15, MTMR10, TRPM1, KLF13, OTUD7A, CHRNA7 and miRNA gene (hsa-mir-211) genes.

[M] The method of paragraph [J], wherein the determination is performed using an oligonucleotide-based array comparative genomic hybridization (oligonucleotide-based CGH).

[N] The method of paragraph [J], wherein the determination is performed using a bacterial artificial chromosome-based array comparative genomic hybridization (BAC-based CGH).

[O] The method of paragraph [J], wherein the determination is performed using a fluorescence in situ hybridization (FISH).

[P] The method of paragraph [J], wherein the determination is performed using a multiplex ligation-dependent probe amplification (MLPA).

[Q] A method for diagnosing an autism spectrum disorder in a human individual or a human fetus, the method comprising determining whether or not the human individual or the human fetus carries a between about 500 kb and about 2 Mb long microdeletion on chromosome 15q13.2q13.3, wherein presence of the between about 500 kb and about 2 Mb long microdeletion on chromosome 15q13.2q13.3 is indicative of diagnosis of the autism spectrum disorder in the human individual or the human fetus.

[R] The method of paragraph [Q], wherein the microdeletion on chromosome 15q13.2q13.3 is located between a BP4 and BP5 region of the chromosome 15q13.2q13.3.

[S] The method of paragraph [Q], wherein the microdeletion is about 500 kb long.

[T] The method of claim [Q], wherein the wherein the microdeletion comprises MTMR15, MTMR10, TRPM1, KLF13, OTUD7A, CHRNA7 and miRNA gene (hsa-mir-211). genes.

[U] The method of paragraph [Q], wherein the determination is performed using an oligonucleotide-based array comparative genomic hybridization (oligonucleotide-based CGH).

[V] The method of paragraph [Q], wherein the determination is performed using a bacterial artificial chromosome-based array comparative genomic hybridization (BAC-based CGH).

[W] The method of paragraph [Q], wherein the determination is performed using a fluorescence in situ hybridization (FISH).

This invention is further illustrated by the following examples which also should not be construed as limiting. The contents of all references cited throughout this application, as well as the examples, figures and tables are incorporated herein by reference in their entirety.

EXAMPLE 1

Focus Oligonucleotide-based Array CGH for Clinical Diagnosis

Genomic imbalance causes a variety of human genetic disorders, ranging from imbalance of entire chromosomes, as in Down syndrome, to submicroscopic rearrangements, as in the 22q11 deletion that causes DiGeorge/velocardiofacial syndrome. Genomic imbalance also causes idiopathic mental retardation (Shaw-Smith C, et. al., 2004, J Med Genet., 41:241-8; Schoumans J, et. al., 2005, J Med Genet., 42: 699-705) and is detectable in approximately 30%-4% of cases (Shevell M, et al., 2003, Neurology, 60:367-80) by traditional cytogenetic methods, such as karyotype and fluorescence in situ hybridization (FISH) analyses (Bejjani and Shaffer, 2006, J Mol Diagn., 8:528-33). These traditional cytogenetic methods are labor intensive, especially when multiple genomic regions are interrogated. genomic copy number of multiple targets (de Vries BB, et al., 2005, Am J Hum Genet., 77:606-16). Microarray-based comparative genomic hybridization (CGH) offers the ability to interrogate many more genomic regions in a single assay. Early CGH arrays were composed of large-insert bacterial artificial chromosome (BAC) clones (Pinkel D, et al., 1998, Nat Genet., 20:207-11). BAC-based arrays have revolutionized the detection of genomic imbalance in clinical cytogenetic laboratories (Bejjani and Shaffer, supra; Bejjani B A, et al., 2005, Expert Rev Mol. Diagn., 5:421-9) but are challenging to develop, validate, and manufacture. The fact that BAC clones in standard libraries may be inaccurately mapped could lead to diagnostic errors without careful validation (Bejani B A, et al., 2005, Am J Med Genet A., 134:259-67). Additionally, BAC clone inserts average approximately 150 kb, limiting the resolution of detectable copy-number variants (CNVs) to the size of a BAC insert. Deletion breakpoints that extend beyond the BAC clone cannot be accurately determined. Once validated, BAC arrays are much more efficient than multiplex FISH analysis, but genetic information is constantly changing. Consequently, updates to a BAC-based array require successive rounds of extensive probe validation.

Oligonucleotide-based arrays offer advantages over BAC-based arrays, and many platforms are available. Oligonucleotide arrays designed for genotyping single-nucleotide polymorphisms may not provide uniform coverage at all sites of genomic imbalance (Friedman J M, et. al., 2006, Am J Hum Genet., 79:500-13; Ylstra B, et. al., 2006, Nucleic Acids Res., 34:445-50). Custom oligonucleotide arrays that are based on libraries of validated synthetic probes can interrogate clinically relevant genomic regions without the need for large-insert clone libraries. We describe an array based on AGILENT's eArray library, a large collection of 60-mer oligonucleotides specifically selected for robust copy-number analysis (see AGILENT Technologies. eArray 4.5 accessed Aug. 2006). This targeted oligonucleotide-based array provides a flexible and adaptable method for CGH to detect genomic copy-number imbalance in the clinical diagnostic laboratory.

Materials and Methods

Abbreviations

Nonstandard abbreviations: FISH, fluorescence in situ hybridization; MLPA, multiplex ligation-dependent probe amplification; CGH, comparative genomic hybridization; BAC, bacterial artificial chromosome; CNV, copy-number variant; SNR, signal-to-noise ratio. Human genes: CTNS, cystinosis, nephropathic; NPHP1, nephronophthisis 1 (juvenile); CARKL, carbohydrate kinase-like.

Validation Samples

DNA was obtained from the material remaining from 105 samples after previous clinical assays had been completed for patients who originally had been referred for genetic testing with BAC-based array CGH, FISH, karyotyping, or MLPA in the DNA Diagnostic Laboratory at Children's Hospital Boston and the Medical Genetics Laboratories at Baylor College of Medicine. Genomic imbalance was previously identified in 51 (49%) of the 105 samples. Samples with positive results from prior testing were assigned to a "validation set" and subjected to oligonucleotide-array CGH analysis in these 2 laboratories with the array platform described below. Laboratory personnel were blinded to prior testing results. The Children's Hospital Boston Institutional Review Board approved this project.

Clinical Samples

After assay validation, we performed clinical array CGH testing of 211 consecutively submitted samples from presumably unrelated children. Samples were submitted after referral to specialists in the Divisions of Clinical Genetics and Developmental Medicine, and the Department of Neurology for clinical molecular-diagnostic testing. The referring diagnoses for these patients included developmental delay, mental retardation, dysmorphic features, or multiple congenital anomalies. All samples were compared with a reference sample for standard 2-color array CGH, either a 46,XY male or a 46,XX female sample. Reference DNA was purchased from Promega.

Genomic DNA was extracted from whole blood for all samples with a D50K PUREGENE DNA-isolation reagent set (QIAGEN®/Gentra) according to the manufacturer's instructions. All DNA was stored at −20° C.

Chip Design

This focused oligonucleotide chip covers 179 clinically relevant regions of genomic imbalance, including all sub-telomeric and pericentromeric regions, and 95 regions responsible for well-defined microdeletion/microduplication syndromes, mental retardation, and autism. A summary of array coverage is shown on Table 2. A total of 10207 region-specific features and 603 quality-control and negative-control features selected from AGILENT's eArray library are randomly located on the array with a mean spatial resolution of <35 kb within the targeted regions. Each sub-telomeric region has a minimum coverage of 5 Mb. A subset of 660 features is duplicated on each block as a quality-control measure. Arrays were manufactured with AGILENT's SurePrint Inkjet technology. In designing the targeted oligonucleotide-based array, the Database of Genomic Variants was consulted (found at http "colon" "double forward slash" projects "dot" tcag "dot" ca "forward slash" variation "forward slash") to avoid CNVs with no apparent clinical relevance.

Comparative Genomic Hybridization (CGH)

Oligonucleotide-array CGH was performed according to the manufacturer's Oligonucleotide Array-Based CGH for Genomic DNA Analysis protocol (version 3; AGILENT Technologies). Briefly, three µg of DNA (both test sample and control sample) were double digested with Alu I and Rsa I and subsequently purified with QIAPREP® Spin Miniprep kit (QIAGEN® GmbH, Hilden, Germany). Digested samples were labeled with Cy3-dUTP or Cy5-dUTP (Amersham Bioscience, UK) using the Bioprime array CGH DNA Labeling System (INVITROGEN™ Life Technologies, Carlsbad, Calif., USA); paired samples were mixed and subsequently purified by MICROCON® YM-30 (MILLIPORE®, Bilerica, Mass., USA). Labeled probes were mixed with Cot-1 DNA (INVITROGEN™ Life Technologies, Carlsbad, Calif., USA), blocking solution and hybridization solution (AGILENT Technologies, Palo Alto, Calif., USA) and hybridized to our 2×11K focused chip and 244K Human Oligo chip (AGILENT Technologies, Palo Alto, Calif., USA). Hybridizations were performed in a 65° C. oven on a rotating rack for 40 hrs. Arrays were washed with wash 1 and 2 solutions (AGILENT Technologies, Palo Alto, Calif., USA) and scanned immediately using the AGILENT scanner.

Dye-swap verification was performed on all samples with positive findings. For other confirmation assays, BAC-array CGH and FISH confirmation were carried out as described previously (Cheung S W., et. al., 2005, Genet Med., 7:422-32). MLPA confirmation was performed as described previously (Shao H, et. al., 2005, Beijing Da Xue Xue Bao; 37:64-7). The MLPA oligonucleotides for the CTNS (cystinosis, nephropathic) gene are as follows:

```
exon 2,
                                (SEQ. ID. No. 37)
GTTTTCACACTGGGCGAAGGGAGGACT
and (SEQ. ID. No. 38)
CCTGAGCTCTGCCTCTTCCAGTAACATTG;
```

```
exon 6,
                                          (SEQ. ID. No. 39)
CCGAGGATACGCTTTCTTGTGATCC
and (SEQ. ID. No. 40)
GCAGCAGCGCCATTAGCATCATAAACC;

exon 12,
                                          (SEQ. ID. No. 41)
CAACCAAGTTTGGACTCGGGGT
and (SEQ. ID. No. 42)
CTTCTCCATCGTCTTCGACGTCGTC.
```

Data Analysis

Scanned images were quantified with Feature Extraction software (version 9.0; AGILENT Technologies). We used the signal-to-noise ratio (SNR) and the normalized $\log_2$ ratio (test/reference) with 40 nonpathologic individual DNA samples to evaluate the quality and variability of each feature/target. The SNR was calculated by dividing the mean signal intensity of each feature by the mean background signal intensity. Features with a mean SNR <4 or an SD of the $\log_2$ ratio>0.1 were considered to have poor signal quality and high variability and were filtered out before further analysis. These thresholds were chosen empirically and are similar to those used in similar studies (Shaw-Smith C, et. al., 2004, J Med Genet, 41:241-8; Wong K K, et. al., 2007, Am J Hum Gene, 80:91-104).

The filtered data were further visualized with CGH Analytics software (version 3.4; AGILENT Technologies) and evaluated the quality of each test with the quality-control metrics generated with CGH Analytics software. Copy-number aberration was indicated with the Aberration Detection Method 2 algorithm for the data that passed quality-control testing. The Aberration Detection Method 2 algorithm finds intervals of varying size with a consistent, appreciably low, or high $\log_2$ ratio. An aberration filter was set to indicate regions with at least 3 targets showing the same direction in copy-number change. The mean $\log_2$ ratio of each region of potential imbalance was calculated and compared with the SD for the whole dataset. A copy-number gain was called if the mean $\log_2$ ratio was greater than twice the SD of the whole dataset, and a loss was called if the mean was less than −2 SDs. These thresholds were chosen empirically and are similar to those used in other such studies (Locke D P, et. al., 2006, Am J Hum Genet., 79:275-90; Sharp A J, et. al., 2006, Nat Genet, 38:1038-42). Cutoff values for genomic imbalance can be adjusted and set accordingly with the threshold function of CGH Analytics software, especially when a potential mosaic scenario is encountered. Variants not known to be pathogenic were compared with the Database of Genomic Variants, which can be found at the world wide web at http "colon" "double forward slash" projects "period" tcag "period" ca "forward slash" variation "forward slash" to facilitate interpretation.

Results

Evaluation of Target Loci and Overall Chip Performance

Forty sex-matched samples from healthy individuals were analyzed on the array, including 2 self-self hybridizations, to evaluate each feature on the array. Signal quality, $\log_2$ ratio variability, mean SNR, and SD of the $\log_2$ ratio were calculated for each non-control feature. The mean and median signal intensities of all the non-control features were 251 and 178, respectively. The mean and median values of the mean SNRs from all non-control features were 9.05 and 6.39, respectively. More than 91% of the target features had a mean SNR >4. Mean $\log_2$ ratios were distributed symmetrically around the zero value. Only a small fraction of features (52 of 10 025,0.52%) exhibited mean values >0.1 or <−0.1. These features were excluded from the dataset before further analysis. The mean SD of the $\log_2$ ratio of all non-control features was 0.062 (median SD, 0.055).

A $\log_2$ ratio SD of >0.1 for 714 features (7.12%) was demonstrated; these features were categorized as non-ideal targets and excluded them from further analysis. More than 90% of the features passed the feature level filter criteria: an absolute mean $\log_2$ ratio<0.1, a $\log_2$ ratio SD<0.1, and a mean SNR >4. After excluding non-ideal features, the dataset quality improved dramatically. For example, the SD of the $\log_2$ ratio dropped from >0.06 to <0.03. Features with a large $\log_2$ SD largely overlapped those with a low SNR, further validating this filtering approach. Because the non-ideal targets are approximately evenly distributed across the target regions, the overall resolution of the chip is not appreciably affected.

Several key variables were used to evaluate chip quality and to describe the quality of the dataset as a whole. These variables included probe-to-probe $\log_2$ ratio noise (DLR-Spread), the median signal intensity of both channels, background noise for both channels, and SNR. The following cutoffs were used to pass our quality-control testing: DLR-Spread about 0.25, median signal intensity about 50, background noise about 10, and SNR about 15. None of the samples failed quality-control testing because of poor chip quality or problems with hybridization. Two samples failed testing because of DNA impurities; both samples passed quality-control tests after we repurified the DNA.

Chip Validation with Blinded Samples

Next, blindly tested 65 samples were tested for further chip validation. Genomic imbalance had previously been detected in 51 of the 65 samples by BAC-array CGH, FISH, karyotyping, or MLPA, or by some combination of these analyses, and these 51 samples served as positive controls for validation. The remaining 14 samples had previously been tested by targeted BAC-array CGH with non-pathologic results and thus served as negative controls for validation. All samples were traceable to the technologist who performed the hybridizations.

Of the 51 validation samples with a previously detected genomic imbalance (Table 3), the samples from 2 cases demonstrated aneuploidy for an entire chromosome, 3 cases involved unbalanced chromosomal rearrangements, 13 cases had subtelomeric deletions/duplications, 17 cases had interstitial deletions/duplications, and 15 cases were associated with known segmental aneuploidy regions, including Angelman/Prader-Willi syndrome (4 cases), atypical Angelman syndrome on 22q13.3 (1 case), an autism phenotype associated with duplication of 15q11-q13 (1 case), a velocardiofacial/DiGeorge syndrome region (5 cases with deletions and 2 with duplication), and Williams-Beuren syndrome (2 cases).

Across all samples, results from oligonucleotide-array CGH were consistent with the results obtained with the 4 prior methods, but oligonucleotide-based array CGH provided the most precise breakpoint boundaries. FIG. 1 shows a genomic-imbalance event (2q37.3 deletion) identified by oligonucleotide-based array CGH. FISH also confirmation of the 2q37.3 deletion (data not shown).

Oligonucleotide-array CGH detected no appreciable imbalance events in any of the 14 negative controls, with the exception of several reported CNVs. The dye-swap scheme essentially eliminated false-positive results.

To further evaluate the confidence of each imbalance call by oligonucleotide-array CGH analysis, the mean $\log_2$ ratios for each detected imbalance region were calculated and compared with the SD for the whole dataset. The value of the mean $\log_2$ ratio/SD indicates the separability of each imbalance event from the background noise of the whole dataset. For the majority of deletion events detected, the value was less than −3.2, whereas the value was >2.6 for the majority of gain events detected.

Genomic Imbalance Detected in Clinical Samples

Focused oligonucleotide-array CGH was used to test 211 clinical samples that had been ascertained to have come from individuals with developmental delay, unexplained mental retardation, dysmorphic features, or multiple congenital anomalies. In this cohort, the detection rate for genomic imbalance was approximately 11.9% (25 of 211 samples). All abnormal findings were first verified with a dye-swap array CGH and then independently confirmed by either FISH or MLPA. All the genomic-imbalance events, including CNVs with unknown significance, were divided into 3 categories, as is described below. The imbalance events associated with known disorders or likely to cause disease are listed in Table 1.

Genomic Imbalance Associated with Well-defined Disorders

Table 1A lists 12 samples with 10 genomic imbalance events associated with known genetic disorders. In this group, 2 of the samples revealed a complex pattern involving both gain and loss on 2 different chromosomes (case 1) or on the same chromosome (case 2), 2 samples had a well-defined microdeletion syndrome (cases 3 and 4), 1 sample had a subtelomeric deletion (case 5), and 2 samples had whole-chromosome aneuploidy (cases 6 and 7). One dominantly inherited disorder could be diagnosed by the detection of haploinsufficiency for the relevant gene (cases 8 and 9), and 3 cases involved carriers of a recessive allele: deletion at the NPHP1 [nephronophthisis 1 (juvenile); cases 10 and 11] and CTNS loci (case 12). The last 3 cases featured deletions of <100 kb, each of which covered defined disease genes.

Figure 2A:
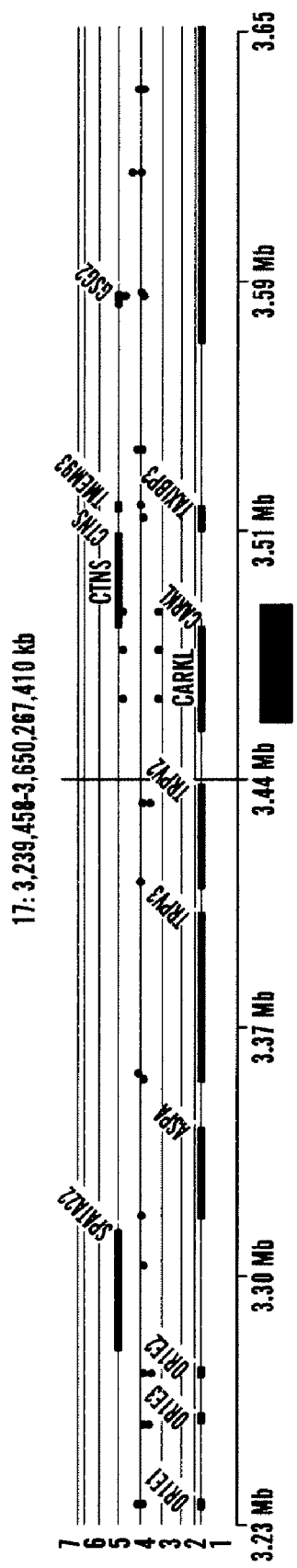
FIGS. 2A-2C demonstrates the oligonucleotide-array CGH detection of a heterozygous genomic deletion of three consecutive probes covering a minimal 23-kb interval.
Figure 2B:
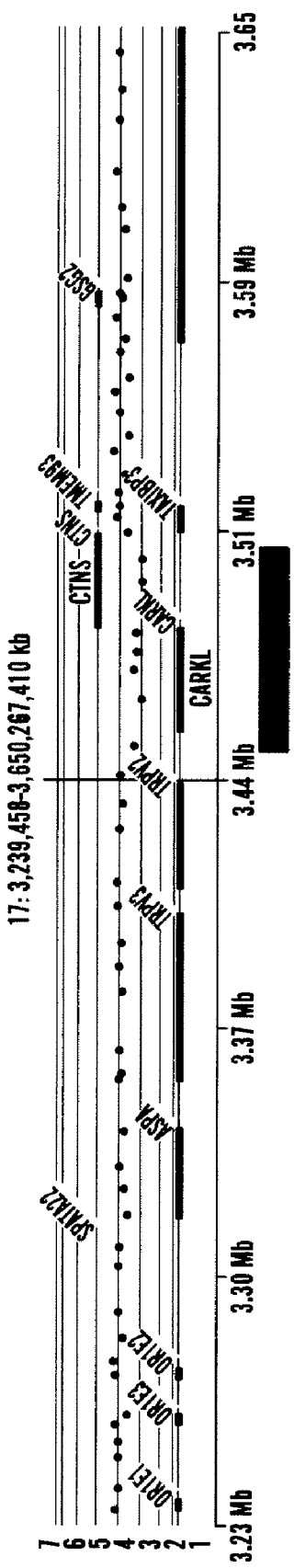
Figure 2C:
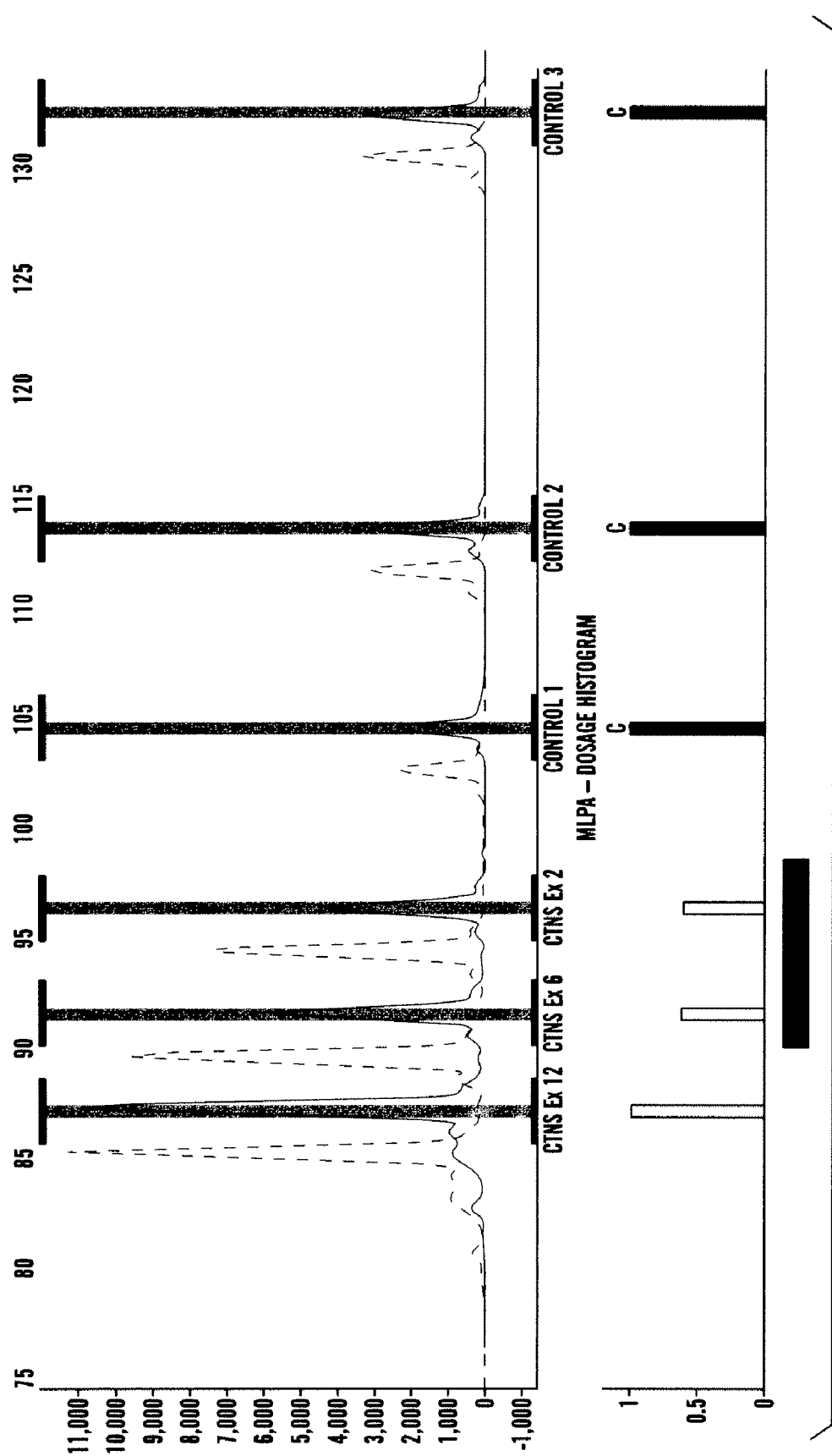
Figure 2D:
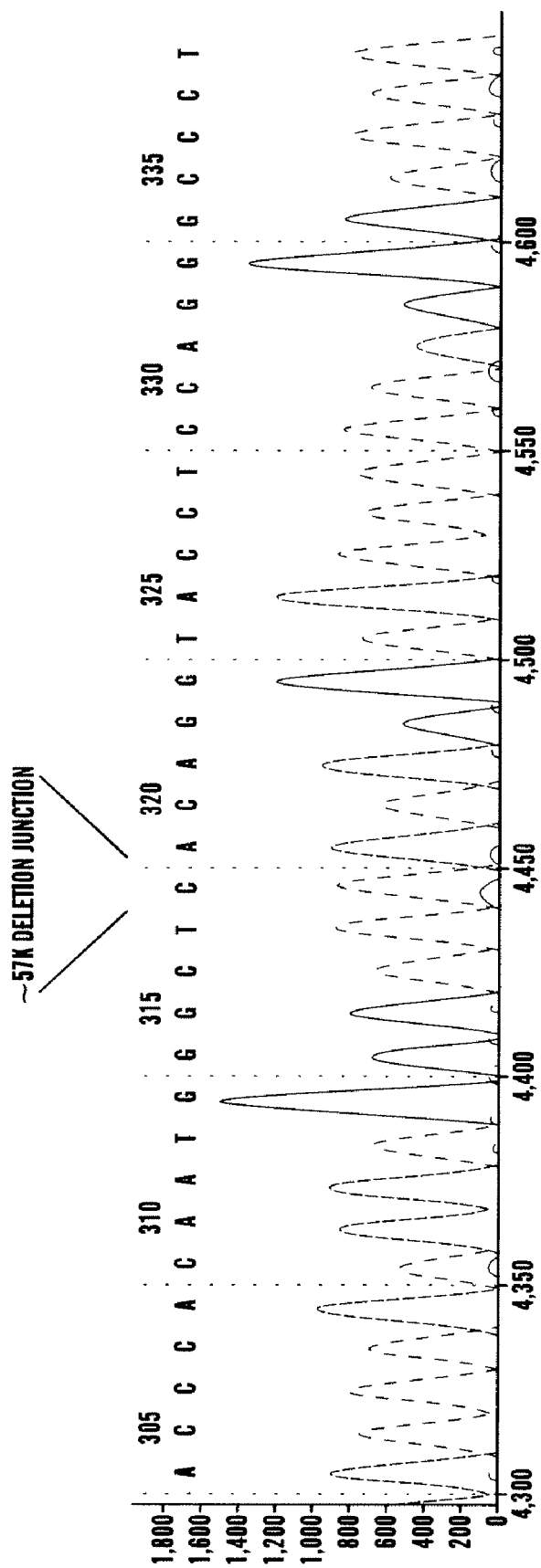
FIG. 2D shows that a segment of the sequencing trace (SEQ. ID. NO: 80) around the deletion junction of the common European deletion. One base (C) overlaps.

Oligonucleotide-array CGH was able to detect cryptic rearrangements, submicroscopic alterations, and even single-gene deletions. The smallest imbalance event detected in this study was a heterozygous genomic deletion of 3 consecutive probes covering a minimal 23-kb interval. FIG. 2A shows the targeted array CGH data, and deletion of the 3 targets was confirmed by dye-swap hybridization (green in the forward hybridization and red in the reverse hybridization). In this case, we repeated the CGH analysis with AGILENT's 244K whole-genome oligonucleotide array and confirmed the deletion, which includes the entire CARKL (carbohydrate kinase-like) gene and part of CTNS (FIG. 2B). The partial deletion of CTNS was independently confirmed by MLPA analysis. FIG. 2C shows a 1-copy deletion for CTNS exons 2 and 6 and a typical dosage for CTNS exon 12. To further characterize the deletion, we amplified the deletion junction by the PCR and confirmed by sequencing (FIG. 2D) that the deletion detected by array CGH is the common "European" deletion associated with cystinosis (Forestier L, et. al., 1999, Am J Hum Genet; 65:353-9). This case further demonstrated the excellent resolution and sensitivity of the custom oligonucleotide-array CGH method.

Genomic Imbalance Probably Cause a Disorder

Table 1B lists 5 samples with interstitial deletions/duplications that may be clinically relevant. The list includes 3 interesting cases: a 3.6-Mb duplication at 17p11.2, which is similar to that of a recently reported 17p11.2-duplication syndrome (Potocki L, et. al., 2007, Am J Hum Genet., 80:633-49), and 2 cases of a 546-kb de novo deletion at 16p11.2, which is within a region of frequently observed cytogenetic polymorphism but not observed in the CNV database. Neither individual with the de novo 546-kb 16p11.2 deletion had specific dysmorphic features, but the absence of this deletion in the parents suggests that the deletion is responsible for the phenotype of developmental delay.

Genomic CNVs with Unknown Significance

Nine patients had unreported CNVs with relatively small genomic deletions of between 50 and 200 kb (data not shown). The clinical significance of these imbalance events is unclear. Although this custom oligonucleotide array was designed to avoid CNVs, many new CNV loci have been reported since the design of the array, which can be found at the world wide web at http "colon" "double forward slash" projects "period" tcag "period" ca "forward slash" variation "forward slash".

Array CGH is a valuable clinical diagnostic assay for patients with mental retardation and other genetic conditions. Although high-resolution whole-genome oligonucleotide microarrays are commercially available for research, targeted array CGH offers several advantages in a clinical diagnostic laboratory (Bejjani B A, et. al., 2005, Am J Med Genet A, 134:259-67). Genomic regions with well-documented clinical relevance were chose, analogous to those of the currently accepted BAC-based arrays designed by the leading array CGH laboratories (Baylor College of Medicine. Chromosomal Microarray Analysis; Signature Genomic Laboratories). Genomic imbalance identified on the targeted oligonucleotide array can be verified with existing FISH or MLPA probes, whereas secondary methods are not readily available for a whole-genome array.

Using 60-mer oligonucleotide probes that are synthesized robotically in situ to manufacture the oligonucleotide-based arrays, we were able to eliminate variability in BAC inserts or DNA contamination between batches and potentially affecting the reproducibility and consistency of the manufactured BAC-based arrays. Moreover, the 60-mers have a fixed GC content and melting temperature that facilitate uniform hybridization, thus reduces the amount of the variability in the performance of some probes.

The sensitivity and specificity of the oligonucleotide-array platform were excellent because of the high SNRs and low SDs. The SDs of all targets were observed to be consistently <0.1—with the majority being <0.08—with this oligonucleotide-based array. Given the nice separability of imbalance events above the baseline, we can identify genomic-imbalance events with a high level of confidence. In addition to the 100% concordance between the oligonucleotide-array CGH results and the results generated by other methods for both positive and negative samples, it was possible to identify smaller imbalance events (unreported CNVs; data not shown) that were not detected with other methods.

Oligonucleotide platforms can quickly and easily accommodate changes in genomic coverage. Manufacturing costs are not prohibitive and the list of available probe sequences extends the length of the genome. Thus, updates to oligonucleotide-based arrays can be accomplished more quickly and with less postproduction validation than BAC-based arrays, which require new BAC clones to be individually validated and DNA to be prepared from each clone before chips can be manufactured.

This focused oligonucleotide-based array CGH platform detected all genomic-imbalance events in the 65 validation samples, with 100% concordance with BAC-based array CGH, FISH/karyotyping, or MLPA. Coverage of clinically relevant loci (see Supplemental Data 1 in the online Data Supplement) is equivalent to other BAC-based targeted array CGH platforms. The enhanced sensitivity and specificity of oligonucleotide-array CGH compared with other methods are attributable to better resolution and the custom design, respectively.

EXAMPLE 2

Autism is a pervasive developmental disorder defined by a neurobehavioral phenotype that includes social disability, communication impairment, repetitive behaviors, and restricted interests.

The relative genetic contribution to a susceptibility to autism from de novo mutations, rare mutations, and common polymorphisms has been debated extensively (Zhao X, et. al., 2007, Proc Natl Acad Sci USA, 104:12831-12836). Recent whole-genome studies assessing copy-number variation4 reported an excess of large de novo copy-number variants, with such events reported in 7 to 10% of simplex families, 2 to 3% of multiplex families, and only 1% of control families (Szatmari P, et. al., 2007, Nat Genet, 39:319-328; Sebat J, et. al., 2007, Science, 316:445-449). Although these data imply a role for de novo copy-number variation, no recurrent events were identified and implicated as having an unequivocal association with autism.

A high-resolution genomewide analysis of a sample of multiplex families in the Autism Genetic Resource Exchange (AGRE) (Geschwind D H, et al., 2001, Am J Hum Genet, 69:463-466) was carried out with the use of the AFFYMETRIX® 5.0 genotyping platform. This platform offers not only single-nucleotide polymorphism (SNP) probes but also a dense collection of SNP invariant probes, which combine to enable detection of copy-number variation. In this study, we describe a screening technique for recurrent de novo autosomal copy-number variants that could influence susceptibility to autism with follow-up analysis of clinical genetic-testing data from Children's Hospital Boston and a large population sample from Iceland (studied at DECODE™ Genetics).
Materials and Methods
Study Design
The samples and methods that were used are summarized in Table 4.
AGRE
Samples
The Autism Genetic Resource Exchange (AGRE) has a collection of DNA from multiplex families with autism spectrum disorder (ASD) available for genetic research (Geschwind D H, et al., 2001, Am J Hum Genet, 69:463-6). 751 families were genotyped. Families with at least one child diagnosed with autism by the Autism Diagnostic Interview-Revised (ADI-R) (Lord C, et al., 1993, Infant Mental Health, 14:234-52) were select, while the second affected child had an AGRE classification of autism, broad spectrum (patterns of impairment along the spectrum of pervasive developmental disorders, including PDD-NOS and Asperger's syndrome) or Not Quite Autism (NQA, individuals who are no more than one point away from meeting autism criteria on any or all of the social, communication, and/or behavior domains and meet criteria for "age of onset"; or, individuals who meet criteria on all domains, but do not meet criteria for the "age of onset"). The self-reported race/ethnicity of these samples is 69% white, 12% Hispanic/Latino, 10% unknown, 5% mixed, 2.5% each Asian and African American, less than 1% Native Hawaiian/Pacific Islander and American Indian/Native Alaskan.

Families with known chromosomal abnormalities (where karyotyping was available) were excluded, and those with inconsistencies in genetic data (generating excess Mendelian segregation errors or showing genotyping failure on a test panel of 24 SNPs used to check gender and sample identity with the full array data) also were excluded. The final dataset included 1,441 affected individuals (1,252 autism, 123 broad spectrum, 66 NQA), 1,420 parents, and 132 unaffected/unknown siblings (Table 4). Some of these same samples were analyzed on AFFYMETRIX® 500K and 5.0 arrays at Johns Hopkins, and analyzed for copy number using AFFYMETRIX® CNAT 4.0 software.
Controls
Additional samples from other ongoing studies used as controls for this study were 1087 cases with bipolar disorder from STEP-BD and 1727 controls obtained from the NIMH Genetics Repository genotyped on the AFFYMETRIX® 500K platform (Sklar P, et al., 2008 Mol Psych. In Press.), and analyzed for CNVs with COPPER (see below).
Genotyping
The samples were genotyped on AFFYMETRIX® 5.0 chips at the Genetic Analysis Platform of the Broad Institute. The 5.0 chip was designed to genotype nearly 500,000 SNPs across the genome in order to enable genome-wide association studies, as well as to improve the assessment of dosage changes by adding 500,000 sequence invariant probes (100,000 of which were targeted towards 1,900 regions of known common copy number polymorphism). In this study, the raw intensity data from these chips is analyzed with two novel algorithms, COPPER and Birdseye, described below. In addition to standard quality control of scans, intensity data was examined for excess variance after normalization. Genotype calling (used here for allele normalization) and quantile normalization of arrays was performed within Birdseed or BRLMM. Both the genotype data and raw intensity files have been released to AGRE, and are available to the research community under AGRE guidelines.
Analysis COPPER
COPy number Polymorphism Evaluation Routine (COPPER, developed by LAW, MARF with technical assistance from DMR) is a method that utilizes allele-specific intensity data from SNP probes to estimate copy number across the genome. It leverages large sample sizes in normalization and can detect small recurrent events in the population (including those that encompass only two local SNP probes). Additionally, it summarizes information from neighboring SNPs per individual to detect larger events (at least six SNP probes) present in single or few samples. Furthermore, COPPER can output normalized intensity data for verification of events by visual examination.

Briefly, it involves 4 steps: 1) normalization of intensity data, 2) copy number calling for each SNP probe, 3) consensus calling for pairs of nearby SNPs, and 4) summarizing data into copy number events. 1) Allele-specific intensity data is normalized and scaled to reflect copy number by assuming that the median intensity for allele A in individuals genotyped as AA corresponds to two copies, the median intensity for allele A in individuals genotyped as AB corresponds to one copy, and the median intensity for allele A in individuals genotyped as BB corresponds to zero copies; likewise for allele B. 2) After adjusting each individual to a genome-wide average of copy number two, the allele-specific quantitative estimates are converted into integer calls of zero to four for each allele and summed across alleles for a copy number call at each locus. 3) Then 'consensus markers' are created by comparing copy number calls for each SNP with the most correlated flanking SNP (considering three on each side), and creating one marker from that pair by setting conflicting calls to missing. Each SNP cannot be used more than once to create a consensus marker. 4) Next, each individual is scanned in windows of five consensus SNPs (stepping by two), and a copy number variant is called if three of the markers in the window are consistent with deletion (copy number <2) or duplication (copy number >2). Therefore, a minimum of six SNPs (3 consensus markers) must reflect copy number less than or greater than two to make a CNV call, reducing false positive calls. Finally, these window calls are summarized into events in each individual with estimated boundaries, and overlapping events are summarized into regions of copy number variation across the sample, with output indicating the number of cases and controls with CNVs in each region, odds ratio, number of positive markers, etc. This method will be described in more detail in a subsequent publication.

Birdseye (developed by JMK) uses both the SNP and copy number probes available on the AFFYMETRIX® 5.0 array to detect copy-number variants (CNVs). On an individual by individual basis, it considers the intensity deviation of each probe using models built from copy number differences on the X chromosome. Birdseye then identifies regions of dosage abnormality in individual samples by combining probe information using a Hidden Markov Model with five states (dosage=0, 1, 2, 3, 4) and employing the standard Viterbi algorithm (Viterbi A. 1967, IEEE Trans Inform Theory, 13:260-9), and generates LOD scores expressing the likelihood of deviation from copy number two in any region. Scans for de novo deletion and duplication events were performed by requiring LOD>6 (i.e., million to one odds) in favor of deletion/duplication in the child but no deletion/duplication in either parent (also with LOD>6).

Briefly, each locus on each plate is modeled independently using empirical data. The response characteristics of each probe are maximum likelihood estimates of mixtures of Gaussians, assuming most samples have normal copy number at that locus. The response of copy number probes is a single Gaussian that best explains the distribution of sample intensities observed, while for SNPs the response is a mixture of 3 Gaussians which are learned using Birdseed (the SNP genotyping algorithm). These Gaussians define the copy-normal clusters. Copy-variable clusters (locus responses) are imputed from these, using a linear regression model built from chromosome X probes (which show differential response for haploid males versus diploid females). Each sample is then independently analyzed using a 5-state HMM-one state per copy number (where copy number at each locus is assumed to be 0, 1, 2, 3, or 4). The models for individual probes serve as point-estimates for the probability of being in each potential copy number state. The transitional probabilities are set low (0.0002 to transition from 2 to variable copy number, 0.05 to transition back to normal copy number, and 0.0001 to transition between two different copy variable states) to reflect the low expected number of CNVs in each genome. The Viterbi best path of copy number states along the genome is then computed for each sample, and for each discovered event a LOD score is reported that reflects the relative probability of the event being true versus false given the observed data.

To assess performance, an in-silico gender mixing experiment was performed. For each probe on the X chromosome, mixture models were built using only female data from a single plate. The order of probes was randomly permuted in order to remove any true CNVs present. A deletion was then simulated by taking the intensity of a female sample for 200 consecutive probes, followed by the intensity of a male sample for N probes, and then another sequence of 200 probes for which female intensity was used (where N is 0, 3, 5, 10, or 20). Each deletion size was simulated 1000 times.

3 probe deletions:
30% found; 28% if limit to correct breakpoints within 1 probe median LOD 1.13 (mean 1.32)
55% of those found have LOD>1
5 probe deletions:
75% found; 71% if limit to correct breakpoints within 1 probe median LOD 2.42 (mean 2.70) 80% of those found have LOD>1 10 probe deletions:
98% found; 93% if limit to correct breakpoint within 2 probes
median LOD 7.80 (mean 7.98) 99% of those found have LOD>1 20 probe deletions:
99% found; 93% if limit to correct breakpoint within 2 probes
median LOD 19.95 (mean 20.00) 99% of those found have LOD>1

Two (false positive) duplications with LODs of 0.19 and 1.16 were found in the simulation, which covered 2,000,000 non-deleted probes (approximately 1 full genome's worth of data). No false deletions were found.

Children's Hospital Boston Samples

Array comparative genomic hybridization (CGH) was performed on 997 consecutively submitted clinical samples, after referral by specialists in Clinical Genetics, Neurology, and Developmental Medicine at Children's Hospital Boston. These fell into two groups: 512 had a primary diagnosis of developmental delay (DD), mental retardation (MR), and/or autism spectrum disorder (ASD) without noted dysmorphic features and 485 were referred for a primary diagnosis other than DD, MR or ASD. In the first group, 129 had ASD as primary indication by the referring clinician, 373 had DD as primary indication, and most have not been formally assessed for ASDs. Among the second group of 485, major referral categories included 141 with a primary diagnosis of multiple congenital anomalies, 106 with dysmorphic features, 43 with seizures, and 41 with congenital heart disease. Of these 485, 51 had a secondary diagnosis of DD or MR and were therefore excluded from analysis, leaving 434 non ASD/DD/MR controls (Table 4). More detailed clinical information about cases with aberrations at 16p11 was obtained by medical records review after approval by Children's Hospital Boston IRB.

Array CGH and Analysis

AGILENT's 244K human genome oligonucleotide CGH microarrays (G441 1 B, AGILENT Technologies, Palo Alto, Calif.) were used for array CGH analysis at Children's Hospital Boston (Shen Y, et al., 2007, Clin Chem, 53(12)). Test samples labeled with Cy5 were compared to a reference sample labeled with Cy3 for standard two-color array CGH or vice-versa in reverse dye labeling setting. Images were captured by an AGILENT scanner and quantified using FEATURE EXTRACTION software v9.0. CGH analytic software v3.4 was subsequently used for data normalization, quality evaluation and data visualization. Copy number aberrations were indicated using the ADM-2 (Aberration Detection Method 2) algorithm.

Figure 3B:
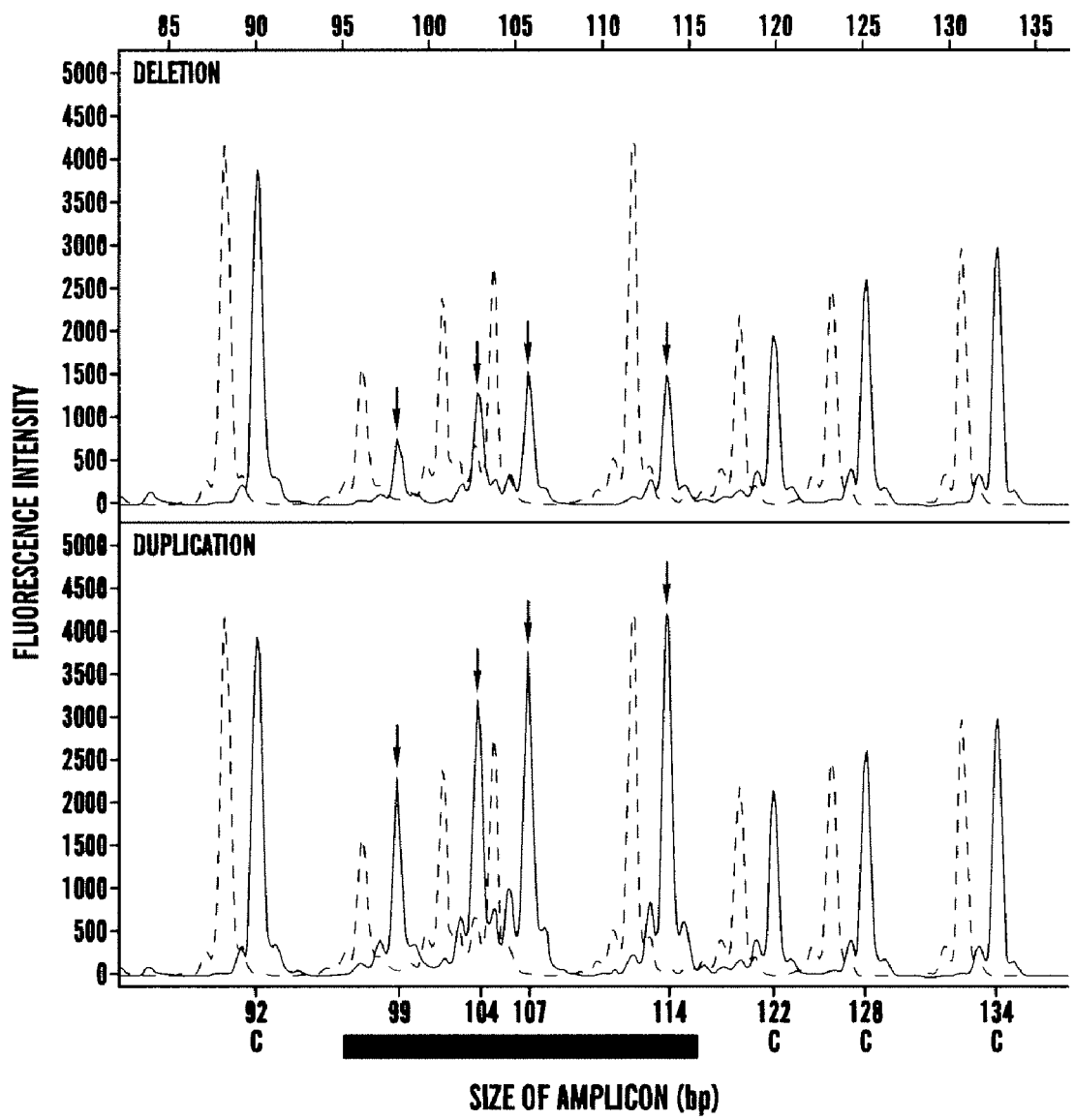
Figure 3C:
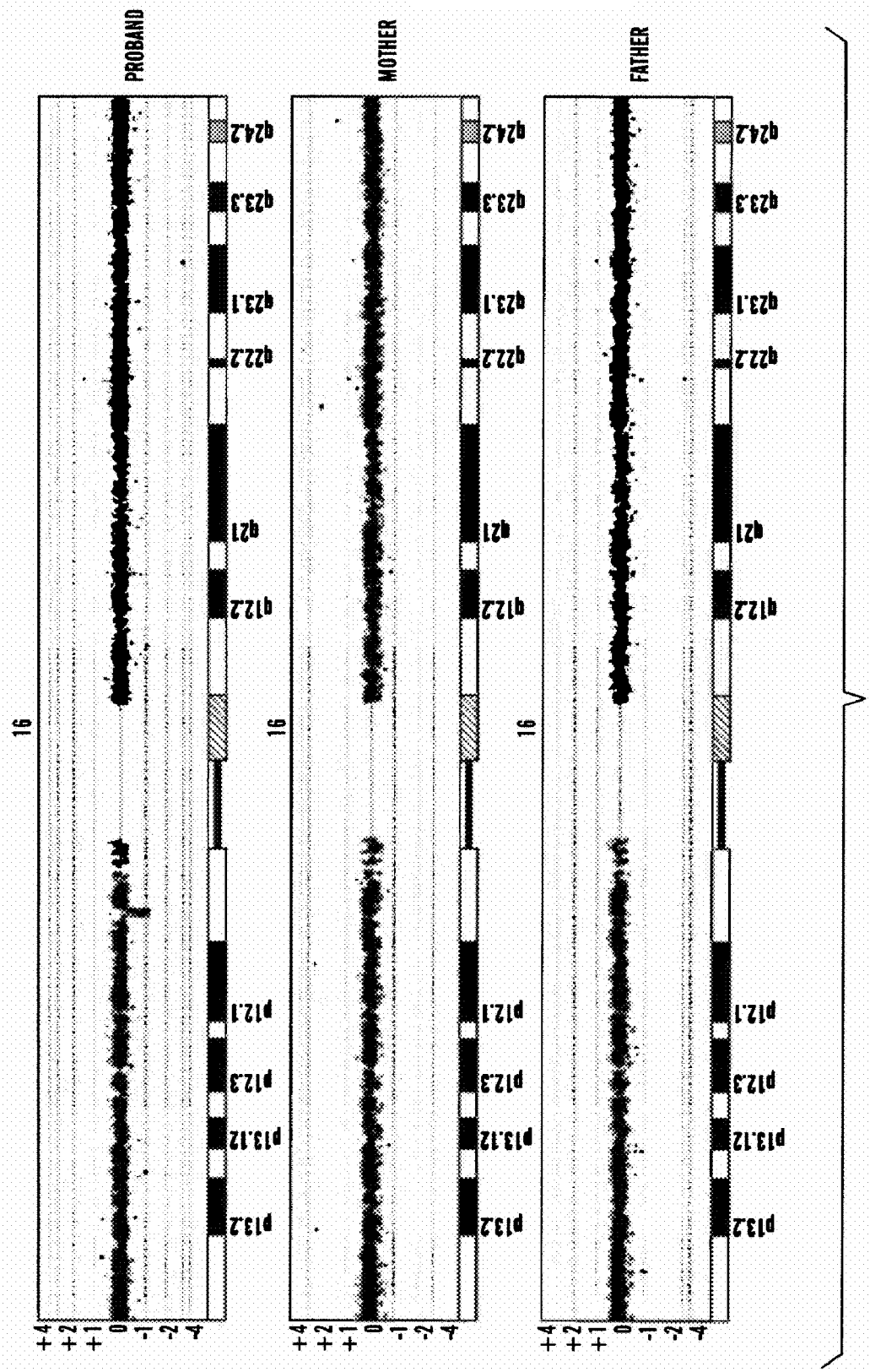

Multiplex Ligation-dependent Probe Amplification (MLPA) and Fluorescent In Situ Hybridization (FISH) Design and Analysis To independently confirm the deletion/duplication of 16p11.2 region, four pairs of MLPA target-probes were designed based on the unique sequences of four genes within this interval: SPN, MAZ, TAOK and TBX6. Additionally, four pairs of MLPA control probes were included, two pairs corresponding to unique sequences of SEPT1 and LAT genes located on chromosome 16 outside the deletion interval, and two pairs corresponding to unique sequences on other chromosomes. All probes were synthetic oligonucleotides. M LPA reagents were commercially available (M RC-Holland, Amsterdam, Netherlands), and reactions were performed according to the manufacturer's instructions. Final PCR products were analyzed on an ABI3730XL for peak identification and quantification. Copy number alterations were visually inspected by superimposing the peak profile of a test sample with the profile of a normal sample using SoftGenetics GENEMARKER software (SoftGenetics, LLC. State College, Pa.) as shown in FIG. 3C. For actual copy number quantification, the peak areas were exported to a Microsoft Excel worksheet. Peak area for each probe was normalized to the mean value for all control probes. The relative ratio of each peak was calculated by comparing between test sample and normal sample. Deletion was identified as relative ratio<0.75 and duplication as relative ratio>1.25.

FISH confirmation was performed as described previously 5 using BAC clone RP11-50412 as a probe specific to the 16p11 .2 deletion interval.

DECODE™ Iceland Samples

Searching for sequence variants affecting the risk of autism was done through a population study of autistic individuals ascertained through the State Diagnostic Counseling Center and the Department of Child and Adolescent Psychiatry in Iceland. 299 cases were investigated and for 90% of them the parents or caregivers of each affected individual were queried using the Autism Diagnostic Interview-Revised (ADI-R 2) (Table 4). The rest of the group (10%) is comprised of older individuals diagnosed according to the ICD-9 (WHO 1978) criteria for autism. For this study, all ICD-9 diagnoses were converted by clinical specialists to ICD-10 diagnoses (World Health Organization. The ICD-10 Classification of Mental and Behavioural Disorders. Diagnostic criteria for research. Geneva 1993). The diagnostic evaluation also included cognitive/developmental assessment, medical work-up and consultation with child and adolescent psychiatrist and/or developmental pediatrician.

All sample and data collection connected to the project, and relevant control samples, has been conducted by a licensed patient recruitment center (PRC). The PRC is a separate, not-for-profit trust company that serves as a link between study participants and researchers. This is where encryption of all research material takes place. The PRC is staffed with experienced nurses who work closely with the clinicians in the recruitment process using the same approach. The DNA samples were isolated from whole blood by conventional methods.

All participants, cases and controls, returned signed informed consents prior to participation in the study. All personal identifiers associated with medical information, questionnaire results, and blood samples were encrypted according to the standards set by the Data Protection Committee of Iceland (Gulcher J R, et. al., 2000, Eur J Hum Genet, 8:739-42). All procedures related to this study have been approved by the Data Protection Authority and National Bioethics Committee of Iceland.

Genotyping and Analysis

A total of 24,258 Icelandic individuals were genotyped at DECODE™ Genetics for 317,503 SNPs using the SENTRIX® HumanHap300 BeadChip (ILLUMINA®). Deletions and duplications at 16p11 were detected using a Hidden Markov Model applied to the SNPs normalized intensity data (similar to the approach described in Colella S, et. al., 2007, Nucleic Acids Res; 35(6):2013-25).

Statistical Methods

The Fisher's Exact Test was used to compare carrier frequency between cases and controls.

Replication

Children's CGH sample was identified in advance as part of collaborative work supported by the Autism Consortium. DECODE™ Genetics researchers (RF, ES, HS, KS) contacted MJD after presentation of preliminary results at recent scientific meeting with offer to replicate this finding. We know of no additional replication attempts at this time.

These novel methods have good power to detect deletions spanning at least 10 probes (approximately 30 kb) on the AFFYMETRIX® 5.0 platform. AGRE samples only from persons without known chromosomal anomalies, the fragile X syndrome, and other established syndromes were screened.

The study was approved by the institutional review boards at the Massachusetts Institute of Technology (for the AGRE samples) and Children's Hospital Boston (for the Children's Hospital samples) and by the Data Protection Authority and National Bioethics Committee of Iceland (for the DECODE™ samples). Written informed consent was obtained from all subjects in the AGRE and DECODE™ research studies. Children's Hospital Boston carried out comparative genomic hybridization for clinical diagnostic purposes; since results were anonymous and obtained by chart review, research-based informed consent was not required by the institutional review board that approved the study.

Results

Copy-Number Abnormalities

To discover recurrent deletions or duplications conferring a risk of autism in multiple families, the COPPER algorithm was used to identify regions in which three or more patients with autism had overlapping copy-number (or genomic "dosage") abnormalities—that is, regions that had either fewer than or more than two genomic copies were targeted in this study. To ensure that these regions were not sites of common copy-number polymorphism, the study was focused on regions that were variant in less than 1% of parents of subjects with autism. For each event predicted by COPPER and meeting these criteria, visual inspection of intensity data was used, whether the same event was predicted with Birdseye, and analysis of mendelian inheritance to assess the confidence in the observation.

32 high-confidence regions and 15 lower-confidence regions were identified, and all but 1 of these regions appeared to be normally segregating variants. Of these regions, 16 (including 8 with high confidence) had at least one de novo event in which both parents were negative for the copy-number variant, suggesting the possibility of recurrent mutation. Although the majority of these variants did not cosegregate with autism (and probably constitute rare, neutral copy-number variations), one region stood out as having multiple de novo events and no inherited events.

Microdeletion on Chromosome 16p11.2

A region on chromosome 16p11.2 (from genomic coordinates 29.5 Mb to 30.1 Mb) was unique in our data. Five children (four boys and one girl) with autism in four independent families carried de novo deletions; we observed no deletions in the parents. One pair of siblings who were not monozygous twins shared the de novo event, presumably inherited from a parent with germ-line mosaicism. In the children with autism, it was observed that the 16p11.2 deletion occurred on chromosomes derived from both the mother and the father.

The region coincides perfectly with a segment of 593 kb flanked by a 147-kb segmental duplication with 99.5% sequence identity. The identification of this cluster of de novo events by COPPER was confirmed by analysis of the same data with the use of Birdseye, with perfect agreement in identification of five samples with this deletion (FIGS. 3A and 3B). In addition, three of these samples overlapped with subjects who were genotyped at Johns Hopkins with AFFYMETRIX® 500K chips in an autism sample (provided by the National Institute of Mental Health), where the same deletions were identified by CNAT 4.0 (AFFYMETRIX®). The size of these deletions (593 kb, containing 86 distinct sites with SNP or copy-number probes) generates confidence that this observation is genuine, with all five subjects having a logarithm of the odds (LOD) of more than 50 in favor of a dosage of 1 (i.e., a hemizygous deletion) (Table 6). The deletion was not observe in the parents of these five children (LOD >50 in favor of a normal dosage of 2 in all parents), nor was the deletion observed in any of the 1420 parents in this study.

Deletion and normal dosage were positively confirmed by multiplex ligation-dependent probe amplification (MLPA) for all subjects in all four of these AGRE families (FIG. 3C). However, in 2814 samples from other studies (unpublished data), three female control subjects (who participated in a study of bipolar disorder but were not screened for autism) carried the deletion. The deletion rate in this population is much lower than the rate in the sample of children with autism (P=0.03 for the deletion), although it suggests that the deletion does not cause severe autism in every case.

Duplication in Families with Autism

Reciprocal duplication of the 593-kb deleted region was observed in three AGRE families (with at least one family member with a LOD>30) (FIG. 3). This duplication was inherited in two families: it was transmitted from a parent to two of two affected offspring (male and female) as well as to one unaffected daughter and from another parent to four of four affected sons. In the third family, the duplication appeared to be a de novo event in one of two affected male offspring. The full duplication was not observed in any of the 2814 samples from other studies analyzed and thus appears to be a high-penetrance risk factor conferring risk to seven additional subjects with autism in the AGRE sample (P=$1.1 \times 10^4$ for both deletions and duplications) (Table 4 and Table 6).

Additional Duplications in AGRE Families

Five large duplications of three different sizes in the 15q11-13 region associated with the Prader-Willi and Angelman syndromes were identified (Table 5). Of these duplications, one was maternally inherited, one occurred in a subject whose father had a normal dosage and whose mother was unobserved, and three were de novo duplications; the smallest extended from genomic position 23 Mb to 25 Mb on chromosome 15. This relatively small duplication could help to focus candidate-gene studies since it included only two genes—ATP10A and GABRB3.

de novo deletion or duplication of a recently implicated gene, NRXN1 on chromosome 2 (Szatmari P, et al. 2007, Nat Genet, 39:319-328; Kim H-G, et al. Am J Hum Genet, 2008, 82:199-207) was not observed although it was observed that six families had deletions within the NRXN1 locus. The deletions did not cosegregate with autism in four of the six families (i.e., not all affected persons inherited the deletion) and were not associated with autism on the basis of a transmission disequilibrium test. Deletions at this locus were observed in 5 of the 2814 control samples. Other events coincident with regions that were highlighted in two recent studies (Szatmari P, et al. supra; Sebat J, et al. 2007, Science, 316:445-449) are listed in Table 7.

To obtain a more complete tally of potentially causal recurrent events, the Birdseye algorithm was used to search for de novo deletions and duplications of 20 kb or larger in genom-ewide data obtained from the AGRE samples. No additional de novo events was found in multiple subjects that were not observed in the International HapMap Project or in 2814 samples from control subjects. Although approximately 50 de novo events of more than 100 kb that were not seen in Hap-Map were detected, a number of these events did not cosegregate with autism in other families or they have been observed in samples from subjects who did not have autism; all such events require further study in additional subjects and much larger control samples before those that may confer susceptibility can be identified.

Confirmation in Clinical Samples

Replication of the association between the 16p11.2 microdeletion and autism was tested in a sample of 512 children with developmental delay, mental retardation, or autism spectrum disorder who were identified independently at Children's Hospital Boston with the use of comparative genomic hybridization. Five additional 16p11.2 deletions were identified (all in boys, including one pair of monozygotic twins); the boundaries of the deletion in each case were identical to that described above (FIG. 3 and Table 8). One deletion was inherited from a mother with mild mental retardation, and the rest were de novo.

By contrast, no deletions of this region were observed in samples from 434 patients at Children's Hospital Boston that were tested by comparative genomic hybridization in the same laboratory. Samples from these children were submitted for diagnostic testing because they had dysmorphic features, multiple congenital anomalies, congenital heart disease, seizures, or other phenotypes in which developmental delay, mental retardation, or autism spectrum disorder was not indicated by the ordering physician.

The duplication at 16p11.2 was also observed in four independent samples (two from boys and two from girls) from the 512 children who were tested with the use of array comparative genomic hybridization for developmental delay, mental retardation, or autism spectrum disorder; the duplication was not observed in any of the 434 children who were tested for other diagnoses. This finding significantly reinforces the association of dosage abnormalities at 16p11.2 and phenotypes associated with autism spectrum disorder and developmental delay (P=0.007 for both deletions and duplications) (Table 9). Clinical features are described in Table 9. All deletions and duplications in this sample were positively confirmed with the use of MLPA and fluorescence in situ hybridization (FISH) (FIG. 3C and data not shown).

Replication in an Icelandic Sample

It was observed that 3 of 299 subjects with autism spectrum disorder from Iceland carried the 16p11.2 deletion, a finding that was consistent with the 1% frequency observed in children at Children's Hospital Boston who had sporadic developmental delay or autism spectrum disorder (Table 10). One of these deletions was de novo, the origin of the second deletion was not known, and one was inherited from a father who had attention deficit-hyperactivity disorder (ADHD). By contrast, in a control sample of 18,834 subjects who did not undergo screening for a psychiatric or language disorder, only two deletions were observed—in other words, the deletion was observed more often in patients with autism by a factor of 100 (P=$3.7 \times 10^{-5}$). However, in a study of the same population by investigators at DECODE™ Genetics, this deletion was observed at a markedly increased rate in subjects with a psychiatric or language disorder. This study showed that the deletion was present in 1 of 648 patients with schizophrenia, 1 of 420 patients with bipolar disorder, 1 of 203 patients with ADHD (the father of a child with autism, as noted above), and 1 of 3000 patients with panic disorder, anxiety, depression, or addiction. In addition, 1 of 748 patients with dyslexia carried the deletion. Overall, in the Icelandic samples, the carrier frequency among patients with autism was 1%; the frequency was approximately 0.1% among patients with a psychiatric or language disorder and 0.01% in the general population.

The duplication of this region was not observed in any of the Icelandic subjects with autism spectrum disorder but was observe it in two subjects with bipolar disorder and five unscreened control subjects, with a carrier frequency of 0.04% in subjects with a psychiatric or language disorder and in 0.03% of the general population.

In total, the identical deletion of nearly 600 kb was observed in 13 subjects with autism (10 confirmed de novo mutations, 2 confirmed inherited mutations from parents with ADHD or mental retardation, and 1 mutation of unknown inheritance), with the reciprocal duplication of the same region documented in 11 additional subjects.

In conclusion, regions of rare copy-number variation have been identified in families with autism. In addition, there is an association between a microdeletion on chromosome 16 (and the inherited reciprocal duplication) and autism. Both the deletion and the duplication are likely to be mediated by the 147-kb segmental duplication flanking the deleted or duplicated sequence.

EXAMPLE 3

Recurrent microdeletion or microduplication events are a common cause of developmental delay and mental retardation (Shaw-Smith C, et al., 2004, J Med. Genet., 41(4):241-8; Schoumans J, et al., 2005, J Med Genet, 42(9):699-705). Most of these events are mediated by recombination between segmentally duplicated sequences through an established mechanism of non-allelic homologous recombination, or NAHR (Lupski J R. 1998, Trends Genet; 14(10):417-22). Microdeletion or microduplication through intrachromosomal recombination between segmentally duplicated sequences is an established mechanism associated with congenital developmental disorders such as the Smith-Magenis syndrome, the Williams syndrome, the Potocki-Lupski syndrome (17p11.2 duplication), and the DiGeorge syndrome (22q11 deletion). The goal of this study is aimed at discovering microdeletion or microduplication that are associated with autism.

Materials and Methods
Children's Hospital Boston Samples

Whole genome high resolution oligonucleotide array CGH were performed on 1,445 consecutively submitted clinical samples with referring diagnoses including developmental delay (DD; n=639), mental retardation (MR) or learning disability (LD; n=49 for MR/LD), autism spectrum disorder (ASD; n=177) or pervasive developmental disorder (PDD; n=85; total for ASD/PDD=262), multiple congenital anomalies (n=118), dysmorphic features (n=224), seizures (n=49) or undefined/other phenotypes (n=104). All patients with 15q13 imbalance were examined by a developmental specialist and a clinical geneticist. A team of specialists from Clinical Genetics, Neurology, and Developmental Medicine at Children's Hospital Boston conducted a medical record review approved by the Children's Hospital Boston Institutional Review Board (IRB).

Array CGH and Confirmatory Studies

CGH was performed according to previously published methods of analysis using the AGILENT 244K human genome oligonucleotide CGH microarray; all coordinates reflect human genome build 18 (G4411B, AGILENT Technologies, Palo Alto, Calif.) (Shen Y, et al., 2007, Clin Chem., 53:2051-9). Independent confirmation of deletion/duplication of the 15q13.2q13.3 region was performed by multiplex ligation-dependent probe amplification (MLPA) and fluorescence in situ hybridisation (FISH) according to previously described methods (Shen Y, et al., supra).

AGRE Samples

DNA samples from 751 multiplex families were obtained from the Autism Genetic Resource Exchange (AGRE) collection of multiplex families (Geschwind D H, et al., 2001, Am J Hum Genet., 69:463-6) using previously described sample selection criteria (Weiss L A, et al., 2008, N Engl J Me., 358:667-75). The final dataset included 1,441 individuals affected with autism spectrum disorders, 1,420 parents, and 132 unaffected/unknown siblings. This study was approved by the Massachusetts Institute of Technology (MIT) IRB.

Genotyping and Confirmatory Studies

AGRE samples were genotyped on AFFYMETRIX™ 5.0 arrays at the Genetic Analysis Platform of the Broad Institute, and analyzed for copy number variants with the COPPER and Birdseye algorithms (Weiss L A, et al., 2008, N Engl J Me., 358:667-75; Korn J M, et. al., Submitted 2008). SNP genotype data and raw intensity files have been released to AGRE, and are available to the research community under AGRE guidelines. Independent confirmation of deletion/duplication of the 15q13.2q13.3 region among AGRE samples was performed using AGILENT 244k array CGH and MLPA at Children's Hospital Boston.

Methods for MLPA

Independent confirmation of deletion/duplication of the 15q13.2q13.3 region was performed using four pairs of multiplex ligation-dependent probe amplification (MLPA) probes based on unique sequences of four genes within this interval: MTMR15, TRPM1, OTUD7A and CHRNA7. The assay included seven pairs of MLPA control probes, three pairs corresponding to unique sequences of TJP1, CHRFAM7A and RYR3 genes located on chromosome 15 outside the deletion interval, and four pairs corresponding to unique sequences on other chromosomes. All probes were synthetic oligonucleotides. MLPA reagents were commercially available (MRC-Holland, Amsterdam, Netherlands), and reactions were performed according to the manufacturer's instructions.

Results

Figure 4:
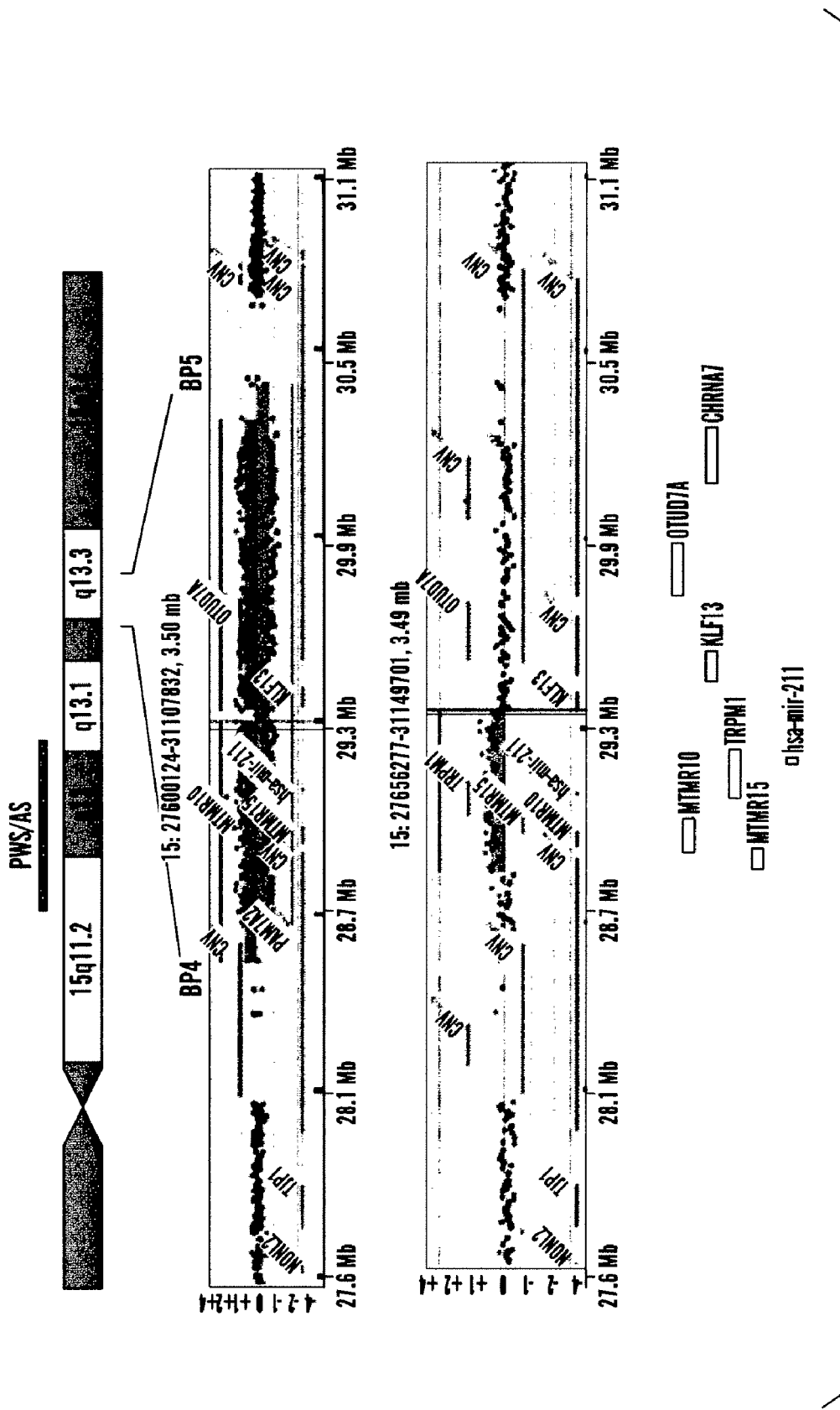
FIG. 4 show additional chromosomal analyses. Top panel shows an ideogram of proximal chromosome 15q (15q11q14) shows the PWS/AS region and the more distal 15q13.2q13.3 region between BP4 and BP5. Lower panel shows scatter plots of array CGH data for a deletion of about 1.5 Mb superimposed with dye-swap scatter plot (note the mirrored distribution of spots). The lower scatter plot represents a duplication of about 500 Kb within the BP4-BP5 interval. The relative positions of 7 genes (6 reference genes and one miRNA gene) are shown in the bottom panel (grey bars). The 1.5 Mb deletions (chr15:28.719-30.232 Mb; hg18) include all 7 genes, while the 500 kb duplications (chr15: 28.902-29.404 Mb; hg18) contain 4 genes (MTMR15, MTMR10, TRPM1 and hsa-mir-211) within the BP4-BP5 at chromosome 15q13.2q13.3.
Figure 5:
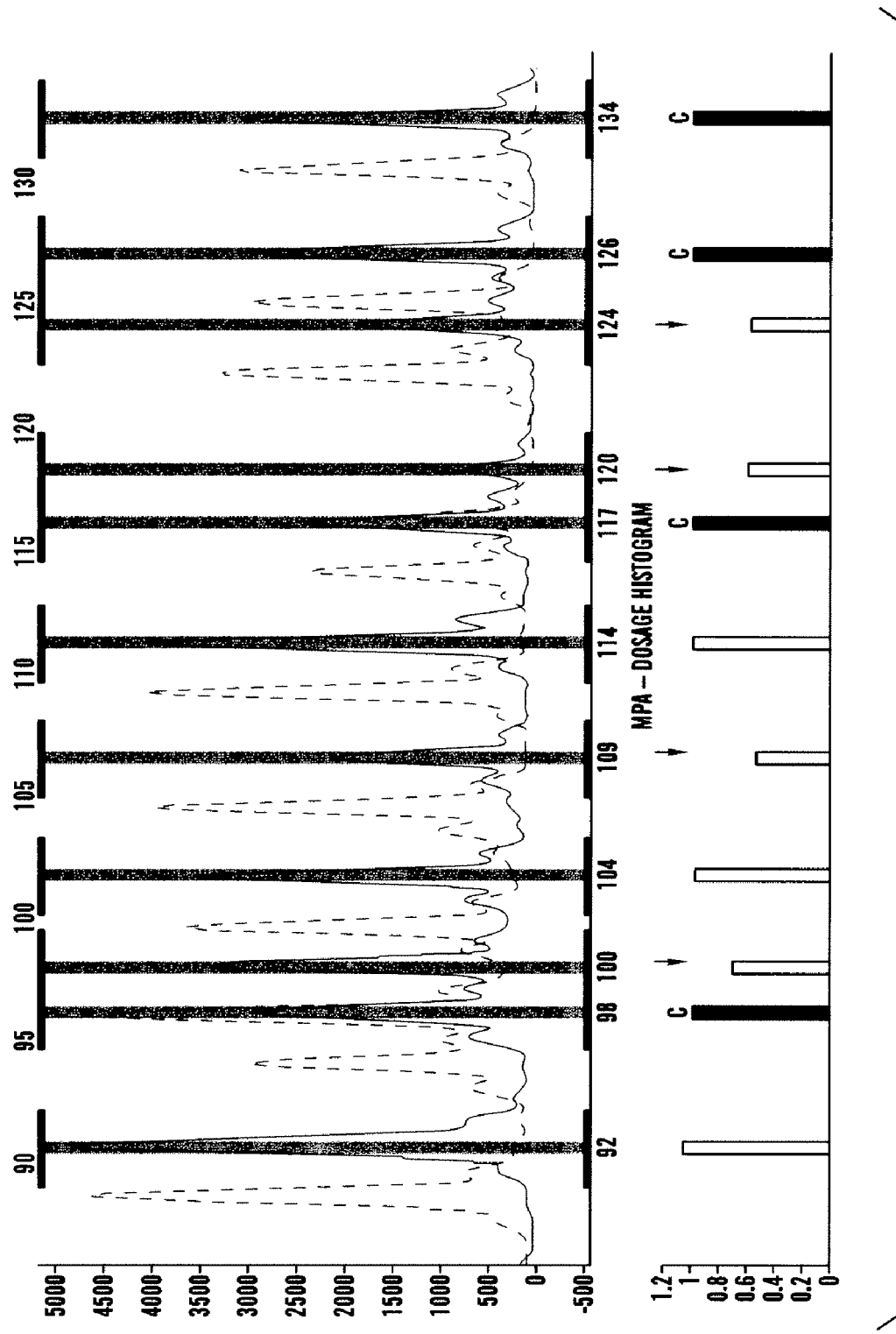
FIG. 5 summarizes the 15q13.2q13.3 del/dup MLPA and shows the results of MLPA for patient 1 with deletion. Top panel is overlapping MLPA traces for case (lighter traces) and control (darker traces) samples. Bottom panel is a histogram of normalized peak height for probes located within the imbalanced 15q13.2q13.3 region (arrows), probes on chromosome 15 outside the imbalance interval (unlabelled black bars), and control probes located on other chromosomes (C).

Ten patients with genomic imbalance at chromosome 15q13.2q13.3, including five with BP4-BP5 microdeletions from the CHB cohort (chr15:28.7 Mb to about 30.3 Mb; hg18) were identified. No cases of BP4-BP5 microdeletion among 1,420 parents and 132 unaffected/unknown siblings in the AGRE samples were found. Three patients with reciprocal BP4-BP5 duplications; and two siblings with a smaller duplication of about 500 kb within BP4-BP5 (chr15:28.9-29.4 Mb; hg18; FIG. 4) were identified. BP4 is more than 1 Mb distal to the telomeric breakpoint (BP3) of the 15q11q13 deletion associated with PWS/AS and the reciprocal duplication that has been associated with autism. None of the patients from CHB or AGRE had other clinically significant copy number variants elsewhere in the genome. All CHB patients had normal karyotypes and fragile X testing by Southern blot and PCR. All deletion and duplication events in these samples were confirmed by dye reversal array CGH (FIG. 4) and through a customized FISH or MLPA assay (data not shown and FIG. 5). Genomic coordinates of the deletions and duplications associated with autism are listed in Table 11.

In general, cognitive performance of patients with 15q13.2q13.3 microdeletion/microduplication was variable. Test scores ranged from moderate MR to the normal range. Although some patients had full-scale IQ in the normal range, they all had some degree of language impairment and/or learning disability. Expressive language was consistently more delayed than receptive language. Many of these individuals showed capacity for ongoing improvement in academic and social skills. Neurobehavioral symptoms were very common in microdeletion/microduplication patients. All had difficulties with social interactions. Overall, dysmorphic features were mild (data not shown), and the neurobehavioral symptoms were the most significant cause of disability among these patients.

15q13.2q13.3 Microdeletion Patient

Clinical features of the one individual (patient 3) from the CHB cohort with 15q13.2q13.3 BP4-BP5 deletions are presented in Table 11. All have subtle dysmorphology findings based on examination by a clinical geneticist. Cognitive testing was performed on the individual. Patient 3 showed significant nonverbal learning disability but has no history of developmental regression. There is mild impaired language skills. Profiles commonly included developmental or oromotor dyspraxia with disarticulation.

Motor delays were not prominent, especially compared to cognitive and behavioral issues, but were observed among in patient 3 with BP4-BP5 deletion. Patient 3 had hypotonia that resolved over time. Patient 3 with BP4-BP5 deletion had exam findings that is not consistent with cerebral palsy.

Patient 3 with BP4-BP5 deletion has a diagnosis of an autism spectrum disorder. Autistic features such as variably poor eye contact and other difficulties with social interactions. Beyond concerns about autistic features, patient 3 has ADHD, bipolar disorder, and anxiety disorder but have no problem sleeping at night.

15q13.2q13.3 Microduplication Patients

Clinical features of four individuals from the CHB and AGRE cohorts with 15q13.2q13.3 BP4-BP5 duplications are presented in Table 11. They have a diagnosis of autism. Patients 6 and 8 also have severe expressive language delay, but language testing results were not available on Patients 9 and 10. Patient 6 has a history of anxiety spectrum disorder/obsessive-compulsive disorder in addition to autism. Cognitive and behavioral test results are not available for duplication patients from the AGRE cohort, although Patient 8's Vineland Score suggests he would fall in the range of mental retardation. Clinical examination of Patient 6 did not suggest a consistent pattern of dysmorphology and neither had a history of seizures. Patients 8-10 (AGRE cohort) were not available for exam.

Patient 6 (CHB cohort) and Patient 8 (AGRE cohort) have a de novo duplication and an autism diagnosis. Patients 9 and 10 (AGRE cohort) are siblings with autism and a smaller duplication nested within BP4-BP5 inherited from their apparently unaffected mother.

Clinical information for 15q13.2q13.3 BP4-BP5 microdeletion cases

Patient 3

Patient 3 is a 10 year 9 month Asian male with bipolar disorder, ADHD, generalized anxiety disorder, and a nonverbal learning disability. He has required medication with Depakote, Risperdal, and Cogentin.

He scored in the normal range of IQ. His Wechsler Intelligence Scale for Children-Fourth Edition (WISC-IV) scores were Verbal Comprehension 93 (32nd percentile), Perceptual Reasoning 90 (25th percentile), Working Memory 77 (6th percentile) and Processing Speed 93 (34th percentile), Full Scale IQ is 86 (18th percentile). His receptive language is mildly to moderately impaired while his expressive language is moderately impaired. Executive functions were compromised based on the Behavior Rating Inventory of Executive Function Global Executive Composite score of 87 (99th percentile).

He has particular difficulty with executive functions and has weak social skills. His play skills are particularly immature. He has difficulty reading social cues and interacting with other children. Behavioral problems include impulsivity, aggression, and anxiety. He has significant learning disabilities, attentional problems, and psychiatric symptoms, but not cognitive developmental delay. He has not had an ADOS.

Mild dysmorphic facial features include a slightly long midface, upslanting palpebral fissures, epicanthal folds, broad nasal root, and posteriorly rotated ears. Extremity exam is notable for tapering fingers, fifth finger clinodactyl), hyperextensible elbows, and pes planus. There were no neurocutaneous lesions. Neurological exam revealed only mild diffuse hypotonia with normal strength and deep tendon reflexes.

Patient 6

Patient 6 is a 20 y/o Caucasian male with BP4-BP5 duplication and a diagnosis of autism, moderate mental retardation, and obsessive-compulsive disorder. His receptive language is moderately to severely impaired while expressive language is severely impaired. He is nonverbal, uses only a few signs, and uses keyboard and other communication aid with speech therapy. He has a history of repetitive behaviors (hand flapping; swinging; spinning) and poor eye contact. His social interactions are significantly impaired, and he has difficulty with transitions.

Dysmorphology exam revealed small midface and apparent frontal bossing due to the large cranium with deep set eyes. He is also significant for severe dental crowding and supernumerary teeth. He has a very tall narrow palate; narrow palpebral fissures, and hyperpigmetned macules on the penis which has led to a diagnosis of Bannayan-Riley-Ruvalcaba syndrome. Gene sequencing for PTEN was normal in clinical and research laboratories. At age 2-11/12, axial hypotonia noted, but tone was recorded as normal by age 7 y 1 m (at that time, noted to have tight heel cords). As a teenager, poorly cooperative for a neurological exam, but apparently nonfocal with a normal gait. He has no history of seizures and has not had an EEG other than a sleep study performed at age 7 which did not mention any abnormal EEG. He had a head CT at 6 months due to macrocephaly and an MRI at age 1 y that were both read as normal.

Patient 8

Patient 8 from the AGRE repository is an 8 y male (mix of Caucasian and Africa American) with a de novo BP4-BP5 duplication and a diagnosis of autism based on the Autism Diagnostic Interview-Revised (ADI-R). This child had significant delays in expressive language with a performance level equivalent to 1 y 4 m at chronolofical age 7 y 7 m on the Vineland Adaptive Behavior Scales. This child had one sibling with autism who did not have the BP4-BP5 duplication. No additional phenotypic information was available.

Patients 9 and 10

Patient 9 and 10 from the AGRE repository are Caucasian male siblings with a maternally inherited duplication of 502 kb (Chr15: 28902339-29404603; hg18; MTMR15, Interview-Revised (ADI-R). The mother who carries the same duplication is apparently unaffected. No additional phenotypic information was available.

The phenotype of chromosome 15q13.2q13.3 BP4-BP5 microdeletion/duplication syndrome can include features of autism spectrum disorder. Recognition of this broader phenotype has implications for clinical diagnostic testing and efforts to understand the underlying etiology of this syndrome.

TABLE 1

Genomic imbalance identified in clinical samples by oligonucleotide-array CGH and confirmed with alternative methods.

| Genomic imbalance detected by focused oligonucleotide-array CGH | Cytogenetics (FISH/karyotype), MLPA, whole-genome CGH/targeted PCR | Confirmation |
|---|---|---|
| (A) Associated with disorders | | |
| 13qter gain, 20.7 Mb; 18qter loss, 5.6 Mb (partial trisomy 13q and partial monosomy 18q) | 46, XX, add(18)(q2?1.3) ish der(18)t(13; 18)(D13S327+, 18qtel11−) | Consistent |
| 18pter-p11.21 loss, 13.4 Mb; 18p11.21 gain, 1.3 Mb (partial monosomy 18p and partial trisomy 18p) | 46, XX ish 18pter(D18S552 X 1), 18p11.21 (RP11-720L3 X 3) | Consistent |
| 17p11.2 loss, 3.6 Mb (Smith-Magenis syndrome) | 46, XX, ish del(17)(p11.2 p11.2) | Consistent |
| 1p36.21 loss, 1.8 Mb (1p36 deletion syndrome) | 46, XY, ish del(1)(p36.2) | Consistent |
| 4q35.2 loss, 1.1 Mb (autism spectrum disorder) | 46, XY, ish del(4)(qter−) | Consistent |
| X gain (aneusomy X) | 47, XXY | Consistent |
| Y gain (aneusomy Y) | 47, XYY | Consistent |
| Yp11.2 loss, 2.7 Mb: 2 cases | ish Yp11.2 (RP11-115H13 X 0) | Consistent |
| 2q13 loss, 100 kb (NPHP1 deletion): 2 cases | Confirmed by whole-genome array CGH | Consistent |
| 17p13 loss, 23 kb (CARKL and CTNS deletion; familial) | Confirmed by whole-genome array CGH, MLPA, parental array CGH, and PCR flanking the deletion | Consistent |
| (B) Likely clinically relevant | | |
| 17p11.2 gain, 3.3 Mb | 46, XY, nuc ish 17p11.2 (RP11-363P3 X 3) | Consistent |
| 16p11.2 loss, 546 kb (de novo): 2 cases | 46, XY, ish del(16)(p11.2 p11.2) | Consistent |
| 15q13.3 gain, 1.5 Mb | nuc ish 15q13.3 (RP11-303I13 X 3) | Consistent |
| 5q22.1-q23.1 loss, 8.5 Mb | Confirmed by whole-genome array CGH | Consistent |

TABLE 2

Genomic Coverage with Oligo Array CGH (CHB Version 1.0)

| OMIM # | Region | Gene(s) | Associated Conditions |
|---|---|---|---|
| n/a | 41 sites | multiple | Subtelomeric del/dup for all chromosome arms |
| n/a | 43 sites | multiple | Marker chromosomes that contain a centromere |
| n/a | Aneuploidy | multiple | Aneuploidy for chromosomes 13, 18, 21, X, and Y |
| 253280 | 1p34.1 | POMGnT1 | Muscle-Eye-Brain disease |
| 607872 | 1p36 | DVL1 | Monosomy 1p36 |
|  | 1q41-42.12 | multiple | Possible Congenital Diaphragmatic Hernia Locus |
|  | 2p21 | SIX3 | Holoprosencephaly 2 |
| 164280 | 2p24.1 | MYCN | Feingold syndrome |
| 256100 | 2q13 del | NPHP1 | Nephronophthisis 1/Joubert 4 |
|  | 2q22-23 | multiple | 2q22-23 del syndrome |
| 606708 | 2q31.1 | DLX1/DLX2 | Split-hand/foot malformation 5 |
| 186000 | 2q31.1 | HOXD13 | Synpolydactyly/Syndactyly I |
| 600430 | 2q37 | GPR35 | Albright hereditary osteodystrophy-like brachydactyly |
| 605934 | 2q37.1-37.3 | HPE6 | Holoprosencephaly 6 |
| 110100 | 3q22 | FOXL2 | Blepharophimosis, Ptosis, Epicanthus Inversus (BPES) |
| 220200 | 3q24 del | ZIC1 ZIC4 | Dandy-Walker malformation |
| 605289 | 3q28 del | TP73L | Split-hand/foot malformation 4 |
|  | 3q29 del | PAK2, DLG1 | 3q29 del syndrome |
| 194190 | 4p16 del | WHS | Wolf-Hirschhorn syndrome |
| 180500 | 4q25 del | PITX2 | Rieger syndrome, Type 1 |
|  | 4q32 del |  | 4q32 del with autism |
| 122470 | 5p13.1 del | NIPBL | Cornelia de Lange syndrome |
| 123450 | 5p15.2 del | multiple | Cri-du-chat syndrome |
| 175100 | 5q22 del | APC | Familial adenomatous polyposis (FAP) |
| 117550 | 5q35.2-35.3 del | NSD1 | Sotos syndrome |
| 119600 | 6p21.1 del | RUNX2 | Cleidocranial dysplasia |
| 176270 | 6q16.3 del | SIM1 | Prader-willi-like syndrome |
| 175700 | 7p13-14.1 | GLI3 | Greig cephalosyndactyly |
| 101400 | 7p21.1 del | TWIST1 | Saethre-Chotzen syndrome |
| 194050 | 7q11.23 del | ELN | Williams-Beuren syndrome |
| 194050 | 7q11.23 dup |  | Split-hand/foot malformation 1 |
| 142945 | 7q36.3 del | SHH | Holoprosencephaly 3 |
|  | 8p22-p23.1 dup/del |  | 8p22 del/dup syndrome |
| 222400 | 8p23.1 del |  | Congenital Diaphragmatic Hernia 2 |
| 214800 | 8q12 del | CHD7 | CHARGE syndrome |
| 113650 | 8q13.3 del | EYA1 | Branchio-oto-renal syndrome (BOR) |
| 150230 | 8q24 del | TRPS1, EXT1 | TRPS, type 2 (Langer-Giedion) |
| 190350 | 8q24.12 del | TRPS1 | Trichorhinophalangeal syndrome, type 1 |
| 109400 | 9q22.3 del | PTCH | Basal cell nevus syndrome (Gorlin syndrome) |
| 161200 | 9q33.3 del | LMX1B | Nail-patella syndrome |
| 191100 | 9q34 del | TSC1 | Tuberous Sclerosis 1 |
| 236670 | 9q34.1 del | POMT1 | Walker/Warburg Syndrome |

TABLE 2-continued

Genomic Coverage with Oligo Array CGH (CHB Version 1.0)

| OMIM # | Region | Gene(s) | Associated Conditions |
|---|---|---|---|
| 610253 | 9q34.3 del | EHMT1 | 9q34.3 del syndrome |
| 601362 | 10p14 del | DGSII | DiGeorge syndrome/VCFS, region 2 |
| 146255 | 10p14 del | GATA3 | Hypoparathyroidsim, SNHL, and renal dysplasia |
| 600095 | 10q24.3 dup | DAC | Split hand/split foot syndrome 3 |
| 601224 | 11p11.2 del | EXT2, ALX4 | Potocki-Shaffer syndrome |
| 106210 | 11p13 del | PAX6 | Aniridia type 2 |
| 194072 | 11p13 del | WT1/PAX6 | WAGR |
| 194070 | 11p13 del | WT1 | Wilm's Tumor 1 |
| 130650 | 11p15.5 dup/del | IGF2 | Beckwith-Wiedemann |
| 161015 | 11q13.2 | NDUFV1 | Leukodystrophy and myoclonic epilepsy |
| 147791 | 11q23 del | multiple | Jacobsen syndrome |
| 601803 | 12p tetrasomy | | Pallister-Killian |
| 163950 | 12q24.1 del | PTPN11 | Noonan syndrome |
| 180200 | 13q14 del | RB1 | Retinoblastoma/MR |
| 609637 | 13q32 del | ZIC2 | Holoprosencephaly 5 |
| 105830 | 15q12 | UBE3A | Angelman syndrome |
| 176270 | 15q11.2 | SNRPN | Prader-Willi syndrome |
|  | 15q11.2q13 maternal dup | | Autism |
|  | 15q21 del | | 15q21 del syndrome |
| 142340 | 15q26.1 del | NR2F2 | Diaphragmatic hernia 1 |
| 601313 | 16p13.3 | PKD1 | Polycystic kidney disease (dominant form) |
| 180849 | 16p13.3 | CREBBP | Rubinstein/Taybi |
| 191100 | 16p13.3 | TSC2 | Tuberous Sclerosis 2 |
|  | 17p11.2 | | dup(17)(p11.2p11.2) syndrome |
| 182290 | 17p11.2 del | RAI1 | Smith-Magenis syndrome |
| 118220 | 17p12 dup | PMP22 | Charcot-Marie-Tooth-1A |
| 162500 | 17p12 del | PMP22 | HNPP |
| 247200 | 17p13.3 del | LIS1 | Miller-Dieker syndrome |
| 162200 | 17q11.2 del | NF1 | Neurofibromatosis 1 |
| 114290 | 17q24.3 del | SOX9 | Campomeilc dysplasia |
| 142946 | 18p11.3 del | TGIF | Holoprosencephaly 4 |
| 118450 | 20p12.2 del | JAG1 | Alagille |
| 190685 | 21q22 dup | DSCR1-4 | Down syndrome critical region |
| 236100 | 21q22.3 | TMEM1 | Holoprosencephaly 1 |
| 188400 | 22q11.2 del | TBX1 | DiGeorge syndrome/VCFS, region I |
| 602054 | 22q11.2 dup | TBX1 | dup(22)(q11.2q11.2) syndrome |
| 101000 | 22q12.2 del | NF2 | Neurofibromatosis 2 |
| 250100 | 22q13.31-qter | ARSA | 22q13.3 del syndrome (Angelman-like) |
| 115470 | inv dup(22)(q11.2) | | Cat Eye syndrome |
| 307030 | Xp21 del | GK | Glycerol kinase deficiency |
| 300473 | Xp21.2 del | NROB1 | Adrenal hypoplasia congenita |
|  | Xp21.2 dup | NROB1 | Dosage sensitive sex reversal |
| 300300 | Xp22.1 del | BTK | Bruton agammaglobulinemia |
| 308700 | Xp22.3 del | KAL1 | Kallman |
| 309801 | Xp22.3 del | HCCS | Microphthalmia with linear skin defects |
| 308100 | Xp22.3 del | ARSC1 | Steroid sulfatase deficiency |
| 300495 | Xp22.32 del | NLGN4 | Autism, X-linked, region 2 |
| 127300 | Xp22.33/Yp11.32 | SHOX | Leri-Weill dyschondrosteosis |
| 312080 | Xq21 dup/del | PLP | Pelizaeus-Merzbacher disease |
| 300067 | Xq23 del | DCX | X-linked lissencephaly |
| 306955 | Xq26.2 | ZIC3 | X-linked heterotaxy |
| 300123 | Xq27.1 del.dup | SOX3 | X-linked mental retardation |
| 312750 | Xq28 del | MECP2 | Rett |
| 300017 | Xq28 del | FLNA | PNH, frontometaphyseal dysplasia, otopalatodigital |
| 480000 | Yp11.31 del | TDF | Y chromosome |
| 415000 | Yq11 del | AZF a, b, and c | Y chromosome |

TABLE 3

Genomic imbalance (GI) detected in validation samples
and comparison between oligo array results and alternate methods of detection

| GI size | Oligo array CGH | BAC array CGH | Cytogenetics (FISH/Karyotype) | MLPA | Comparison |
|---|---|---|---|---|---|
| 2.4 Mb | 1p36.3 gain (0-2.4 Mb) | 1p36.3 gain | nuc ish 1p36.3(RP4-740C4x3, RP11-547D24x4) | n/a | Consistent |
| 500 kb | 1q32.1-32.2.gain (20.1 Mb-20.6 Mb) | 1q32.3 gain | ish dup(1)(q32.3q32.3) (RP11-224F8+) | n/a | Consistent |
| 4.3 Mb | 2q22.3-(145.6 Mb-149.9 Mb) | 2q22.3 loss | ish del(2)(q22.3q22.3)(RP11-89L3−) | n/a | Consistent |
| 4.2 Mb | 2q37.2 loss (238.2 Mb-242.4 Mb) | 2q37.2 loss | 46, XX, del (2)(q37.2).ish del(q37.2q37.2) | 2qter loss-subtel | Consistent |

TABLE 3-continued

Genomic imbalance (GI) detected in validation samples
and comparison between oligo array results and alternate methods of detection

| GI size | Oligo array CGH | BAC array CGH | Cytogenetics (FISH/Karyotype) | MLPA | Comparison |
|---|---|---|---|---|---|
| 1.6 Mb | 2q37.3 loss (241.1 Mb-242.7 Mb) | 2q37.3 loss | 46, XY, ish del(2)(q37.3q37.3)(RP11-367H1−) | 2qter loss-subtel | Consistent |
| 1.6 Mb | 2q37.3 loss (241.1 Mb-242.7 Mb) | 2q37.3 loss | ish del(2)(q37.3q37.3)(RP11-367H1−) | n/a | Consistent |
| 54.7 Mb; 4.8 Mb | 3q24-q29 gain (144.7 Mb-199.4 Mb); 18p11.32 loss (0.43 Mb-5.3 Mb) | 3q24-q29 gain; 18p11.32 loss | 46, XY, add(18)(p11.32) | 3q gain-subtel; 18p loss-subtel | Consistent |
| 3.6 Mb | 4p16.3 loss (0-3.6 Mb) | 4p16.3 loss | 46, XY, del(4)(p16.3).ish del(p16.3p16.3) | 4pter deletion | Consistent |
| 200 kb | 4q22.3 gain (98.9 Mb-99.1 Mb) | 4q22.3 gain | ish dup(4)(q22.3q22.3)(RP11-369I16+) | n/a | Consistent |
| 700 kb | 4q35.2 (188.8 Mb-189.5 Mb) | 4q35.2 loss | ish del(4)(q35.2q35.2)(RP11-565A3−) | n/a | Consistent |
| 1.3 Mb; 3.7 Mb | 5p15.33 gain (0-1.3 Mb); 7q36.3 loss (153 Mb-156.7 Mb) | 5p15.3 gain; 7q36 loss | ish der(7)t(5; 7)(p15.3; q36)(5ptel+, SHH−) | 5p15.3 gain-subtel; 7q36 loss-subtel | Consistent |
| 1.9 Mb | 6p24.1 gain (12.7 Mb-14.6 Mb) | 6q24.1 gain | ish dup(6)(q24.1q24.1)(RP3-468K18+) | n/a | Consistent |
| 7.3 Mb | 6q24.1-24.3 loss (140.7 Mb-148 Mb) | 6q24.1 loss | ish del(6)(q24.1q24.1)(RP3-468K18−) | n/a | Consistent |
| 4.1 Mb | 6q26 loss (166 Mb-170.1 Mb) | 6q26 loss | 46, XX, del(6)(q26) | 6qter loss-subtel | Consistent |
| 12 Mb | 7q11.22 loss (61.9 Mb-73.9 Mb) | n/a | n/a | 7q11.23 loss-WBS | Consistent |
| 1.4 Mb | 7q11.22 loss (72.1 Mb-73.5 Mb) | n/a | n/a | 7q11.23 loss-WBS | Consistent |
| Aneuploidy | 8 gain, 21 gain, 13qter gain | n/a | Trisomy 8, trisomy 21, trisomy 13q | n/a | Consistent |
| 7.1 Mb; 4 Mb | 8p23.2-8pter loss (0.181-7.3 Mb); 8q24.3-8qter gain (142 Mb-146 Mb) | n/a | n/a | 8p loss-subtel; 8q gain-subtel | Consistent |
| 17.3 Mb | 8q21.11-21.3 loss (75.3 Mb-92.6 Mb) | 8q21.1 loss | ish del(8)(q21.1q21.1)(RP11-90B7−) | n/a | Consistent |
| 320 kb | 9p24.3 gain (0.09 Mb-0.41 Mb) | 9p24.3 gain | ish dup(9)(pter)(GS-43N6+) | n/a | Consistent |
| 100 kb | 9q34.3 loss (13.7 Mb-13.8 Mb) | n/a | n/a | 9q loss-subtel | Consistent |
| 500 kb | 10q26.3 loss (131.6 Mb-132.1 Mb) | 10q26.3 loss | ish del(10)(q26.3q26.3)(RP11-435P9−) | n/a | Consistent |
| 300 kb | 11p13 loss (3.2 Mb-3.5 Mb) | n/a | n/a | 11p13 loss | Consistent |
| 2.3 Mb | 15q11-12 gain (20.3 Mb-22.6 Mb) | n/a | n/a | 15q11-13 gain-Autism | Consistent |
| 11 Mb | 15q11-13 gain (19.1 Mb-30.1 Mb) | n/a | n/a | 15q11-13 gain PWS/AS | Consistent |
| 6.6 Mb | 15q11-13 gain (20.4 Mb-27 Mb) | n/a | n/a | 15q11-13 gain-PWS/AS | Consistent |
| 300 kb | 15q11-13 loss (20.3 Mb-20.6 Mb) | n/a | n/a | 15q11-13 loss-PWS/AS | Consistent |
| 5.7 Mb | 15q11-13 loss (20.4 Mb-26.1 Mb) | n/a | n/a | 15q11-13 loss-PWS/AS | Consistent |
| 800 kb | 16p11.2 loss (34 Mb-34.8 Mb) | 16p11.2 loss | ish del(16)(p11.2p11.2)(RP11-244B22−) | n/a | Consistent |
| 200 kb | 16p13.12 loss (13.9 MB-14.1 Mb) | n/a | n/a | 16p loss-ERCC4 gene | Consistent |
| 300 kb | 16q24.2 loss (87.8 Mb-88.1 Mb) | 16q24.3 loss | ish del(16)(q24.3q24.3)(RP11-104N10dim) | n/a | Consistent |
| 2.3 Mb | 16q24.3 gain (86 Mb-88.3 Mb) | 16q24.3 gain | ish der(9)t(9; 16)(q34.3; q24.3)(RP11-21B21+, RP11-104N10+, RP11-566K11+) | 16qter gain-subtel | Consistent |
| 3.6 Mb | 17p11.2 loss (16.5 Mb-20.1 Mb) | 17p11.2 loss | ish del(17)(p11.2p11.2)(SMS−) | n/a | Consistent |
| 2.7 Mb | 17p13.2 loss (2.2 Mb-4.9 Mb) | 17p13.2 loss | ish del(17)(p13.2p13.2)(LIS1−) | n/a | Consistent |
| 298 kb | 17p13.3 gain (0.084 Mb-0.382 Mb) | n/a | n/a | 17p gain-subtel | Consistent |
| 1.5 Mb | 18q21.1 loss (44.5 Mb-46 Mb) | n/a | n/a | 18q loss | Consistent |
| 2.5 Mb | 19p13.12 loss (13.8 Mb-16.3 Mb) | 19p13.1 loss | ish del(19)(p13.1p13.1)(RP11-56K21−) | n/a | Consistent |
| 11 Mb | 20p12.3 loss (64.9 Mb-75.9 Mb) | 20p12.3 loss | ish del(20)(p12.3p12.3)(RP11-116E13−) | n/a | Consistent |
| 44 kb | 20pter loss (0-0.044 Mb) | 20p13 loss | ish del(20)(p13p13)(RP11-530N10−) | n/a | Consistent |
| 2.9 Mb | 22q11.21 gain (17.2 Mb-20.1 Mb) | n/a | n/a | 22q11.2 gain-VCFS/DGCR | Consistent |
| 2.9 Mb | 22q11.21 gain (17.2 Mb-20.1 Mb) | n/a | n/a | 22q11.2 gain-VCFS/DGCR | Consistent |
| 2.4 Mb | 22q11.21 loss (16.7 Mb-19.1 Mb) | 22q11.2 loss | ish del(22)(q11.2q11.2)(RP11-316L10−) | n/a | Consistent |
| 2.5 Mb | 22q11.21 loss (17.2 MB-19.7 Mb) | n/a | n/a | 22q11.2 loss-VCFS/DGCR | Consistent |
| 2.9 Mb | 22q11.21 loss (17.2 Mb-20.1 Mb) | n/a | n/a | 22q11.2 loss-VCFS/DGCR | Consistent |

TABLE 3-continued

Genomic imbalance (GI) detected in validation samples and comparison between oligo array results and alternate methods of detection

| GI size | Oligo array CGH | BAC array CGH | Cytogenetics (FISH/Karyotype) | MLPA | Comparison |
|---|---|---|---|---|---|
| 2.9 Mb | 22q11.21 loss (17.2 Mb-20.1 Mb) | n/a | n/a | 22q11.2 loss-VCFS/DGCR | Consistent |
| 2.9 Mb | 22q11.21 loss (17.2 Mb-20.1 Mb) | n/a | n/a | 22q11.2 loss-VCFS/DGCR | Consistent |
| 2.9 Mb | 22q11.21 loss (17.2 Mb-20.1 Mb) | n/a | n/a | 22q11.2 loss-VCFS/DGCR | Consistent |
| 200 kb | 22q13.33 gain (49.2 Mb-49.4 Mb) | n/a | n/a | 22q13.33 gain-ARSA | Consistent |
| Aneuploidy | X gain | n/a | 47, XXY | n/a | Consistent |
| 1.5 Mb | Xp22.31 loss (6.5 Mb-8 Mb) | Xp22.31 loss | ish del(X)(p22.3p22.3)(STS−) | n/a | Consistent |
| 600 kb | Xp22.32 loss (5.2 Mb-5.8 Mb) | Xp22.32 loss | ish del(X)(p22.3p22.3)(RP11-323G19−) | n/a | Consistent |

Size for genomic imbalance indicates minimum.
Abbreviations:
ARSA = Arylsulfatase A gene locus associated with atypical Angelman syndrome;
AS = Angelman syndrome;
DGCR = Di George syndrome critical region;
PWS = Prader-willi syndrome;
WBS = Williams-Beuren syndrome

TABLE 4

Detection of 16p11.2 Copy-Number Variants, According to Sample.*

| Sample | Case Subjects | Control Subjects | Experiment | Analysis | Case Deletion | Case Duplication | number | Control Deletion | Control Duplication | P Value† |
|---|---|---|---|---|---|---|---|---|---|---|
| AGRE | 751 Families, with 1441 case subjects‡ | 1420 AGRE parents and 2814 samples with bipolar disorder or NIMH control | Affymetrix 5.0 for AGRE families, Affymetrix 500K for controls | COPPER and Burdseye for AGRE families, COPPER for controls | 5 | 7 | | 3 | 2 | $1.1 \times 10^{-4}$ |
| Children's Hospital Boston∬ | 512 Children | 434 Children | Agilent comparative genomic hybridization | ADM-2 | 5¶ | 4 | | 0 | 0 | $7.1 \times 10^{-3}$ |
| deCode | 299 Subjects with autism spectrum disorder‖ | 18,834 Subjects not screened for a psychiatric or language disorder | Illumina Human-Hap300 BeadChip | HMM | 3 | 0 | | 2 | 5 | $4.2 \times 10^{-4}$ |

*ADM denotes aberration detection method, AGRE Autism Genetic Resource Exchange, COPPER copy-number polymorphism evaluation routine, HMM hidden Markov model, and NIMH National Institute of Mental Health.
†P Values for deletions plus duplications are for the comparison between case subjects and control subjects, as calculate by Fisher's exact test.
‡Subjects were assessed according to the Autism Diagnostic Interview - Revised (for details, see the Supplementary Appendix).
∬Case subjects had received the diagnosis of developmental delay, mental retardation, or autism spectrum disorder after clinical evaluation. Control subjects had been referred for congenital anomalies not including developmental delay, mental retardation, or autism spectrum disorder.
¶The number includes a monozygotic twin pair.
‖The diagnosis of autism spectrum disorder was made according to the definition in the International Classification of Diseases, 10th revision.

TABLE 5

Duplication of Chromosome 15q11-13 in the AGRE Sample.*

| Chromosome and Region Chromosome 15 | Inheritance and Transmission |
|---|---|
| 21.2-26.3 (BP2-BP3) | 2 De novo copy-number variants |
| 18.8-26.4 (BP1-BP3) | Inherited copy-number variant, 2 transmitted and 0 not transmitted; 1 unknown |
| 23.3-24.7 | De novo copy-number variant |

*Duplications of the region associated with the Prader-Willi and Angelman syndromes were detected by applying novel algorithms to Affymetrix 5.0 genotype data. For inherited events, listed are the number of transmitted copy-number variants and the number of copy-number variants that were not transmitted to affected offspring for whom data were available. AGRE denotes Autism Genetic Resource Exchange.

TABLE 6

Phenotypic Date in AGRE families and Iceland probands with copy number variants at 16p1 1.2. Family Structure and ADI-R and ADOS subscores, as well as performance measures are given for AGRE families and Iceland probands with copy number variants at 16p1 1.2

| ID | Father ID | Mother ID | Gender | Deletion/ Duplication | Scored Affected Status | ADOS Diagnosis | Age at ADI-R Exam | ADI-R Social Total | ADI-R Communication - Verbal Total | ADI-R Communication - Non-Verbal Total | ADI-R Behavior Total | ADI-R Development Total |
|---|---|---|---|---|---|---|---|---|---|---|---|---|
| AU002901 | 0 | 0 | Female | Duplication | | | | | | | | |
| AU002902 | 0 | 0 | Male | | | | | | | | | |
| AU002903 | 2 | 1 | Male | Duplication | Autism | Spectrum | 13.07 | 28 | | | | |
| AU002904 | 2 | 1 | Female | Duplication | | | | | 16 | | 6 | 4 |
| AU002905 | 2 | 1 | Female | Duplication | Autism | Autism | 9.84 | 27 | 17 | | 8 | 3 |
| AU011001 | 9 | 8 | Female | | | | | | | | | |
| AU011002 | 0 | 0 | Male | | | | | | | | | |
| AU011003 | 2 | 1 | Male | | | | | | | | | |
| AU011004 | 2 | 1 | Male | Duplication | Autism | Autism | 7.95 | 26 | 15 | | 7 | 5 |
| AU011005 | 2 | 1 | Male | | Autism | Autism | 5.76 | 27 | 17 | | 4 | 5 |
| AU0154201 | 0 | 0 | Male | | | | | | | | | |
| AU0154202 | 0 | 0 | Female | | | | | | | | | |
| AU0154301 | 201 | 202 | Female | | | | | | | | | |
| AU0154302 | 201 | 202 | Male | Deletion | Autism | Autism | 14.73 | 28 | | 12 | 4 | 5 |
| AU0154303 | 201 | 202 | Female | Deletion | Autism | Autism | 12.85 | 30 | | 14 | 4 | 5 |
| AU029801 | 0 | 0 | Female | | | | | | | | | |
| AU029802 | 0 | 0 | Male | | | | | | | | | |
| AU029803 | 2 | 1 | Male | Deletion | Autism | | 4.79 | 16 | 14 | | 3 | 3 |
| AU029804 | 2 | 1 | Male | | Autism | | 2.95 | 25 | 18 | | 5 | 3 |
| AU032701 | 0 | 0 | Female | | | | | | | | | |
| AU032702 | 0 | 0 | Male | Duplication | | | | | | | | |
| AU032703 | 2 | 1 | Female | | | | | | | | | |
| AU032704 | 2 | 1 | Male | Duplication | Autism | Autism | 9.99 | 28 | 18 | | 4 | 5 |
| AU032705 | 2 | 1 | Male | Duplication | Autism | Autism | 8.36 | 28 | 23 | | 8 | 5 |
| AU032706 | 2 | 1 | Male | Duplication | Autism | Autism | 6.86 | 27 | 18 | | 4 | 5 |
| AU032707 | 2 | 1 | Male | Duplication | Autism | Autism | 10.55 | 26 | 24 | | 8 | 5 |
| AU041901 | 0 | 0 | Female | | | | | | | | | |
| AU041902 | 0 | 0 | Male | | | | | | | | | |
| AU041903 | 2 | 1 | Female | | | | | | | | | |
| AU041904 | 2 | 1 | Male | | Autism | Autism | 7.56 | 28 | | 14 | 6 | 5 |
| AU041905 | 2 | 1 | Male | Deletion | Autism | Autism | 5.92 | 15 | | | 6 | 5 |
| AU0938201 | 0 | 0 | Male | | | | | | | | | |
| AU0938202 | 0 | 0 | Female | | | | | | | | | |
| AU0938301 | 201 | 202 | Male | Deletion | Autism | Autism | 9.32 | 18 | 12 | | 6 | 5 |
| AU0938302 | 201 | 202 | Male | | Autism | Autism | 7.43 | 16 | 13 | | 4 | 5 |
| Iceland Samples | | | | | | | | | | | | |
| Aut1 | Adoptee 1a | Adoptee 1b | Female | Deletion | Autism | Autism | 18.33 | 10 | 10 | | 4 | 1 |
| Aut2 | ADHD 2a | 2b | Male | Deletion | Autism | Autism | 10.58 | 14 | 9 | | 7 | 3 |
| Aut3 | 3a | 3b | Female | Deletion | Autism | N/A | N/A | N/A | N/A | | N/A | N/A |

| ID | Age at ADOS Exam | ADOS Module | ADOS Communication Total | ADOS Social Total | ADOS Communication + Social Total | ADOS Play Total | ADOS Behavior Total | Age at Peabody Picture Vocabulary Test | Peabody Picture Vocabulary Test Estimated Age | Age at Raven | Raven Non-verbal IQ | Age at Vineland | Vineland Score |
|---|---|---|---|---|---|---|---|---|---|---|---|---|---|
| AU002901 | 15.46 | 4 | 3 | 4 | 7 | 1 | 2 | 15 | >22 yrs | 15 | 94 | 16.2 | 6 yrs 8 mos |
| AU002902 | 11.94 | 3 | 6 | 12 | 18 | 2 | 0 | 11 | 10 yrs 9 mos | 11 | 90 | 12.68 | 9 yrs 5 mos |
| AU002903 | | | | | | | | | | | | | |
| AU002904 | | | | | | | | | | | | | |
| AU002905 | | | | | | | | | | | | | |
| AU011001 | | | | | | | | | | | | | |
| AU011002 | | | | | | | | | | | | | |
| AU011003 | | | | | | | | | | | | | |
| AU011004 | 11.09 | 3 | 3 | 8 | 11 | 0 | 3 | | | 11 | 110 | | |
| AU011005 | 8.9 | 3 | 6 | 12 | 18 | 2 | 2 | | | 8 | 136 | | |
| AU0154201 | | | | | | | | | | | | | |
| AU0154202 | | | | | | | | | | | | | |
| AU0154301 | | | | | | | | | | | | | |
| AU0154302 | 14.73 | 1 | 4 | 9 | 13 | 2 | 4 | 14 | | 14 | 70 | | |
| AU0154303 | 12.92 | 1 | 5 | 12 | 17 | 4 | 0 | 12 | | 12 | | | |
| AU029801 | | | | | | | | | | | | | |
| AU029802 | | | | | | | | | | | | | |

TABLE 6-continued

Phenotypic Date in AGRE families and Iceland probands with copy number variants at 16p1 1.2. Family Structure and ADI-R and ADOS subscores, as well as performance measures are given for AGRE families and Iceland probands with copy number variants at 16p1 1.2

| | | | | | | | | | | | |
|---|---|---|---|---|---|---|---|---|---|---|---|
| AU029803 | | | | | | | | | | | |
| AU029804 | | | | | | | | | | | |
| AU032701 | | | | | | | | | | | |
| AU032702 | | | | | | | | | | | |
| AU032703 | | | | | | | | | | | |
| AU032704 | 14.82 | 3 | 4 | 7 | 11 | 0 | 1 | 14 | 14 yrs 9 mos | 14 | 75 |
| AU032705 | 13.19 | 2 | 5 | 8 | 13 | 1 | 5 | 13 | 7 yrs 2 mos | 13 | 50 |
| AU032706 | 11.68 | 3 | 3 | 7 | 10 | 0 | 0 | 11 | 14 yrs 9 mos | 11 | 107 |
| AU032707 | 10.55 | 3 | 6 | 13 | 19 | 1 | 1 | 10 | 9 yrs 3 mos | 10 | 107 |
| AU041901 | | | | | | | | | | | |
| AU041902 | | | | | | | | | | | |
| AU041903 | | | | | | | | | | | |
| AU041904 | 9.65 | 1 | 6 | 8 | 14 | 1 | 5 | 9 | 4 yrs 1 mo | 9 | 78 |
| AU041905 | 7.96 | 3 | 5 | 10 | 15 | 1 | 4 | 7 | 5 yrs 6 mos | 7 | 108 |
| AU0938201 | | | | | | | | | | | |
| AU0938202 | | | | | | | | | | | |
| AU0938301 | 9.32 | 3 | 3 | 7 | 10 | 1 | 3 | 9 | 6 yrs 5 mos | 9 | 80 |
| AU0938302 | 7.43 | 3 | 5 | 9 | 14 | 1 | 3 | 7 | 4 yrs 10 mos | 7 | 70 |

Iceland Samples

| | | | | | | | | WISC-111 Age | WISC-111 VIQ | WISC-111 PIQ | WISC-111 FS |
|---|---|---|---|---|---|---|---|---|---|---|---|
| Aut1 | 18.42 | 4 | 3 | 8 | 11 | 0 | 0 | 17.75 | 65 | 61 | 61 |
| Aut2 | 10.58 | 3 | 7 | 11 | 18 | 3 | 2 | 7.1 | 75 | 75 | 73 |
| Aut3 | N/A | N/A | N/A | N/A | N/A | N/A | N/A | N/A | N/A | N/A | N/A |

TABLE 7

Previously reported CNVs in autism.

| Event reported | | | Events observed | | | | |
|---|---|---|---|---|---|---|---|
| Chr | Mb | event | Chr | Mb | event | Inheritance, transmission (T:U) | Reference |
| 1 | 143.8-144.9 | dup | 1 | 144.8-145.1 | del | inherited, 1:0 | 9 |
| | | | | 143.5-145.0 | del | de novo** | |
| | | | | 143.6-145 | dup | unknown, not shared by affected sib | |
| | | | | 143.5-145 | dup | inherited 1:2 | |
| 2 | 50.4-50.8 | del | 2 | ~50.4 | del | inherited, 1:1 (one add'l possible) | 9 |
| | | | | ~51 (varied) | | inherited, 11:9 | |
| 2 | 162.2-162.3 | del | | none | | NA | 10 |
| 2 | 236.4-249.4 | del | | none | | NA | 10 |
| | 238.2-242.7 | del | | | | | |
| 3 | 60.7-60.8 | del | 3 | 60.9-61.1 | del | parent, 0:4 | 10 |
| | 61.1-61.4 | dup | | 60.8-61.2 | dup | parent, 0:2 | |
| | | | | 60.8-60.9 | dup | parent, 0:1 | |
| 6 | 14.0-15.3 | del | | none | | NA | 10 |
| 7 | 15.2-15.3* | del | | no additional events | | NA | 10 |
| 10 | 50.6-61.5 | dup | | none | | NA | 10 |
| 13 | 44.2-46.1 | del | | none | | NA | 10 |
| 15 | 18.5-30.7 | dup | 15 | 21.2-26.3 | dup | 2 de novo | 10 |
| | | | | 18.8-26.4 | dup | inherited, 2:0; 1 unknown | |
| | | | | 23.3-24.7 | dup | de novo | |
| 16 | 5.99-6.20 | del | 16 | 6.03-6.06 | del | parent, 0:2 | 10 |
| | | | | 6.06-6.08 | del | inherited, 2:0 | |
| | | | | 6.06-6.19 | dup | inherited, 2:0 | |
| 16 | 29.6-31.1 | del | 16 | 29.5-30.0 | del | de novo (5 cases in 4 families) | 10 |
| | | | | 29.5-30.0 | dup | inherited, 7:0, 1 de novo | |
| | | | | 29.6-29.7 | dup | inherited, 1:1 | |
| 17 | 14.3-15.2 | del | 17 | 14.0-15.4 | del | inherited, 2:0 | 9 |
| | 14.3-15.2 | dup* | | | | | |
| 20 | 0.08-0.37 | del | 20 | 0.20-0.22 | del | parent, 0:1 | 10 |

TABLE 7-continued

Previously reported CNVs in autism.

| Event reported | | | Events observed | | | | |
|---|---|---|---|---|---|---|---|
| Chr | Mb | event | Chr | Mb | event | Inheritance, transmission (T:U) | Reference |
| 20 | 2.8-3.9 | del | 20 | 3.72-3.74 | del | inherited, 1:1 | 10 |
|  |  |  |  | 2.9-3.0 | dup | inherited, 1:0 |  |
| 22 | 17.5-19.8 | del | 22 | 19.2-19.8 | del | Unknown | 9 |
|  | 17.5-20.3 | dup* |  | 17.2-19.8 | dup | parents, 0:3 |  |
|  |  |  |  | 16.1-16.3 | dup | inherited, 2:1 |  |
|  |  |  |  | 17.3-18.7 | dup | unknown |  |
|  |  |  |  | 19.0-19.8 | dup | inherited, 1:1 |  |
| 22 | 45.1-49.5 | del | 22 | 45.60-45.65 | del | parent, 0:2 | 10 |
|  |  |  |  | 48.17-48.23 | del | inherited, 4:4 |  |
|  |  |  |  | 48.14-48.18 | del | inherited, 2:0 |  |
|  |  |  |  | 47.7-48.3 | dup | inherited 3:1 |  |

Events featured in the main tables or text of recent studies evaluating copy number in autism.
For each reported event, we include events observed in our data with substantial overlap, and for inherited events, the number transmitted: not transmitted for affected offspring with data.
Our sample has some overlap with previously reported samples,
*indicates a reported event in an overlapping sample which we also detect.
**event not featured in the main text or tables of the paper, but listed in the table in an overlapping sample.

TABLE 8

Clinical information for Children's Hospital deletion cases (Pt#) and Iceland deletion cases (Aut#). Clinical descriptive information is given for the 5 subjects in the Children's Hospital Boston sample with deletions at 16p11.2, and the two subjects in the Iceland sample with deletions at 16p11.2 and clinical data available. The third Iceland subject has a history of seizures, but no other information available.

Physical characteristics of individuals with del(16)(p11.2)

|  | Pt 1 | Pt 2 | Pt 3 | Pt 4 | Pt 5 | Aut2 | Aut1 |
|---|---|---|---|---|---|---|---|
| Gender | Male | Male | Male | Male | Male | Male | Female |
| History |  |  |  |  |  |  |  |
| Speech delay | + | + | + | + | + | + | + |
| Motor delay | + | + | + | + | + | − | + |
| Poor eye contact | + | NA | NA | + | + | + | + |
| Tactile aversion | + | NA | NA |  |  | − | − |
| Self stim behavior | + | NA | NA |  |  | + | − |
| Age at walking | 18 m | 16 m | 17 m | 16 m | 16 m | 13 m |  |
| Regression | − | − | − | − | − | − | − |
| Other |  |  |  |  |  | ADHD, seizure | ADHD |
| Physical Exam |  |  |  |  |  |  |  |
| Age at examination | 6 y 6 m | 2 y 9 m | 17 m | 9 y 2 m | 9 y 2 m | 10 y 6 m | 5 y 2 m |
| Height (% ile) | 108.1 cm ($<3^{rd}$) | NA | 74.2 cm ($<3^{rd}$) | 143.3 cm ($90^{th}$) | 150 cm ($>97^{th}$) | 152 cm ($95^{th}$) | 106 cm ($25^{th}$) |
| Weight (% ile) | 19 kg ($10^{th}$) | NA | 9 kg ($<3^{rd}$) | 65.4 kg ($>97^{th}$) | 71.9 kg ($>97^{th}$) | 69 kg ($>97^{th}$) | 18 kg ($50^{th}$) |
| OFC (% ile) | 51 cm ($50^{th}$) | 52 cm ($90^{th}$) | 48.5 cm ($75^{th}$) | 54.5 cm ($90^{th}$) | 56 cm ($>97^{th}$) | 54 cm ($60^{th}$) | 52.5 cm ($90^{th}$) |
| Facial dysmorphism | − | − | − | − | − |  |  |
| 2-3 toe syndactyly | + | − | − | − | − |  |  |

TABLE 9

Clinical information for Children's Hospital duplication cases. Clinical descriptive information is given for the 4 subjects in the Children's Hospital Boston sample with duplication at 16p11.2.

Physical characteristics of individuals with dup(16)(p11.2)

|  | Pt 1 | Pt 2 | Pt 3 | Pt 4 |
|---|---|---|---|---|
| History |  |  |  |  |
| Gender | Male | Female | Male | Female |
| Speech delay | unknown | + (mild) | + | + |
| Motor delay | + | + | − |  |
| Poor eye contact | NA | − | − |  |
| Tactile aversion | NA | − | − |  |

TABLE 9-continued

Clinical information for Children's Hospital duplication cases. Clinical descriptive information is given for the 4 subjects in the Children's Hospital Boston sample with duplication at 16p11.2.
Physical characteristics of individuals with dup(16)(p11.2)

|  | Pt 1 | Pt 2 | Pt 3 | Pt 4 |
|---|---|---|---|---|
| Self stim behaviors | NA | – | – |  |
| Age at walking | Not crawling or walking yet | NA | 16 m | 14 m |
| Regression | – | – | – | – |
| Other |  | Agenesis of corpus callosum |  | Seizures beginning age 6 m; MR |
| Physical Exam |  |  |  |  |
| Age at examination | 14 m | 3 y 3 m | 2 y 6 m | 9 y 9 m |
| Height (% ile) | NA | 97.2 cm (50-75$^{th}$) | 92.4 cm (50$^{th}$) |  |
| Weight (% ile) | 11 kg (50$^{th}$) | 14.7 kg (50-75$^{th}$) | 15.2 kg (90$^{th}$) | 33.5 kg (50$^{th}$) |
| OFC (% ile) | 80th | 46.5 cm (<3$^{rd}$) | 51.25 cm (95$^{th}$) | 51 cm (25$^{th}$) |
| Facial dysmorphism | – | – | – | – |
| Hypotonia | + (mild) | – | – | – |
| Other |  | Mild spasticity; Fifth finger clinodactyly |  |  |
| Laboratory testing |  |  |  |  |
| Karyotype | NA | NA | 46, XY, dup(16)(q11.2q12.1) | NA |
| Fragile X | NA | NA | NA | NA |

NA = not assessed

TABLE 10

Iceland phenotype information. Clinical diagnosis by ICD-10 category and transmission information is listed for the Icelandic autism samples with deletions at 16p11.2.

| Alias ICE | ICD-10 | Sex | Age | Transmission |
|---|---|---|---|---|
| Aut1 | Autism, mild MR Atypical | F | 22 | No info on parents |
| Aut2 | Autism | M | 12 | Transmitted from father |
| Aut 3 | Asperger's unspecified MR, epilepsy | F | 37 | de novo |

TABLE 11

15q13.2q13.3 microduplications and microdeletions in individuals with autism.

|  | Patient 6 | Patient 3 | Patient 8 | Patient 9 | Patient 10 |
|---|---|---|---|---|---|
| Genetics |  |  |  |  |  |
| Cohort | CHB | CHB | AGRE | AGRE | AGRE |
| Referring Diagnosis | Autism | Autistic Spectrum | Autism | Autism | Autism |
| size | 1.98 Mb Duplication | 1.70 Mb Deletion | 1.93 Mb Duplication | 0.50 Mb Duplication | 0.50 Mb Duplication |
| Coordinates (hg18) | 28,719,136-30,701,432 | 28,709,202-30,405,675 | 28,719,136-30,648,918 | 28,902,339-29,404,603 | 28,902,339-29,404,603 |
| Origin | de novo | Unknown (adopted) | de novo | Maternal | Maternal |
| LCR involved | BP4-BP5 | BP4-BP5 | BP4-BP5 | Internal to BP4-BP5 | Internal to BP4-BP5 |
| Age and Gender | 20 y Male | 10 y 9 m Male | 8 y Male | Male | Male |
| Cognitive/Behavioral Development |  |  |  |  |  |
| Developmental Delay | Yes | Yes | Yes | N/A | N/A |
| Mental Retardation | Yes | No | Not tested | N/A | N/A |
| ASD | Yes | No | Yes, ADOS, ADI-R | Yes, ADI-R | Yes, ADI-R |

TABLE 11-continued

15q13.2q13.3 microduplications and microdeletions in individuals with autism.

|  | Patient 6 | Patient 3 | Patient 8 | Patient 9 | Patient 10 |
|---|---|---|---|---|---|
| Cognitive Testing | FSIQ below 50 | FSIQ = 86%; memory 77; Verbal 93; WISC-IV | N/A | N/A | N/A |
| Receptive Language | Severely impaired (follows simple commands) | Mildly impaired | Severely Impaired | N/A | N/A |
| Expressive Language | Severely impaired (nonverbal) | Mildly impaired | Severely Impaired | N/A | N/A |
| Repetitive behavior | Yes | No | N/A | N/A | N/A |
| Poor eye contact | Yes; variable | Yes | N/A | N/A | N/A |
| Social interactions | Impaired | Impaired | N/A | N/A | N/A |
| Self-stimulatory behaviors | Yes | No | N/A | N/A | N/A |
| Self-injurious behaviors | Yes | Unkown | N/A | N/A | N/A |
| Behavioral issues | Yes | Yes | N/A | N/A | N/A |
| Age at Walking | 12 m | 18 m | N/A | N/A | N/A |
| History of Seizures | None | None | N/A | N/A | N/A |
| EEG | Normal | Normal | N/A | N/A | N/A |
| MRI | Normal | Not done | N/A | N/A | N/A |

TABLE 12

Multiplex ligation-dependent probe amplification (MLPA) probes for identifying microduplications and microdeletions at chromosome 15q13.2q13.3 BP4-BP5 and 16p11.2 loci.

| Probe name | Amplicon size | Probe sequence (first half) | Probe sequence (second half) | Probe type |
|---|---|---|---|---|
| RYR3 | 92 | CCAGATCTCTGCGTCTGCAATTTTGTG (SEQ. ID No 1) | CTGGAACAGTCCCTATCTGTCAG (SEQ. ID No 2) | control |
| CLN5-3 | 98 | CCAACTTGGCAACTGTACATTTCCC (SEQ. ID No 3) | CATCTCCGACCTGAAATGGATGCCCCTTTCT (SEQ. ID No 4) | control |
| CHRNA7 Ex2 | 100 | CAATGACTCGCAACCACTCACCGTCTACTTCTC (SEQ. ID No 5) | CCTGAGCCTCCTGCAGATCATGGAC (SEQ. ID No 6) | target |
| TJP1 | 104 | GACCAGCGGTCAGAGCCTTCTGATCATTCCAGG (SEQ. ID No 7) | CACTCGCCGCAGCAGCCAAGCAATGGCAG (SEQ. ID No 8) | control |
| OTUD7A | 109 | CACAGCCAATCTGCCACATGTGTTCAATGAAGGGCGG (SEQ. ID No 9) | GGTCCCAAGCAGCCAGAGCGAGAGCCACAG (SEQ. ID No 10) | target |
| GREM1 | 114 | GGTCACACTCAACTGCCCTGAACTACAGCCAC (SEQ. ID No 11) | CTACCAAGAAGAAGAGAGTCACACGTGTGAAGCAGTGTCG (SEQ. ID No 12) | control |
| Wnt5a6 | 117 | CTGATTCCTCCGTGTTGTGATGTGATGCTGGCCAC (SEQ. ID No 13) | GTTTCCAAACGGCAGCTCCACTGGGTCCCCTTTGGTTGTA (SEQ. ID No 14) | Control |
| TRPM1 | 120 | GTGTTATCAGCCACGTAGGGGATGCCTTGAAAGACCACTCTC (SEQ. ID No 15) | CAAGTCCAGAGGCCGGGTTTGTGCTATAGGAATTG (SEQ. ID No 16) | target |
| MTMR15 | 126 | GGAGGTCAGGGACAGCTTTCAACAGTCCTGTTGGTCAA (SEQ. ID No 17) | CCTCGGCCGAATGGAGTTTCCTAGTTACACCATCAATCGGAAAACC (SEQ. ID No 18) | target |
| CACAN2D3Ex30 | 129 | GGTGTCTGAAGACTACACACAGGTGAGTGAAAATTTTCTACCAGCTCC (SEQ. ID No 19) | AAGTAAGGATCTCAGAATGTGCTTGGGTCAGGGGAACA (SEQ. ID No 20) | Control |
| CACAN2D3Ex13 | 134 | GTCATGGAATACCTTCACGTGCTTAGCCGGCCCAAAGTCATCGACC (SEQ. ID No 21) | AGGAGCATGATGTGGTGTGGACCGAAGCTTACATTGACAGCACTGT (SEQ. ID No 22) | control |
| SEPT1 | 92 | GCGACGGATGCTGGTGCAGACACA (SEQ. ID No 23) | CCTGCAGGACCTGAAAGAGGTGACGC (SEQ. ID No 24) | control |
| SPN | 99 | GCTTCTCCTTCTCCTTGGGGTGCTGGTG (SEQ. ID No 25) | GTAAGCCCAGACGCTCTGGGGAGCACAAC (SEQ. ID No 26) | target |

TABLE 12-continued

Multiplex ligation-dependent probe amplification (MLPA) probes for identifying microduplications and microdeletions at chromosome 15q13.2q13.3 BP4-BP5 and 16p11.2 loci.

| Probe name | Amplicon size | Probe sequence (first half) | Probe sequence (second half) | Probe type |
|---|---|---|---|---|
| MAZ | 104 | GACACGAGGAGAAAGTGCCATGTCACGTGT (SEQ. ID No 27) | GTGGCAAGATGCTGAGCTCGGCTTATATTTCG (SEQ. ID No 28) | target |
| TAOK | 107 | GCTGGACAACCTGCAGTACCGCAAGATGAAG (SEQ. ID No 29) | AAGATCCTGTTCCAAGAGGCACCCAACGGCCCTGG (SEQ. ID No 30) | target |
| TBX6 | 114 | GTCAGTCACTGGCCTGGACCCCGAGGCCCGCTACTTGTTT (SEQ. ID No 31) | CTTCTGGATGTGATTCCGGTGGATGGGGCTCG (SEQ. ID No 32) | target |
| LAT | 122 | CACTTCCTTTCAGGGTGGTGCTTCCTGACAGCACCCGG (SEQ. ID No 33) | CCACTAGCACTGCTGCCCCATCAGCTCCTGCACTCAGCACC (SEQ. ID No 34) | control |
| NCAM2 | 128 | GCCGCCAGCAATCTCAATGCCTCAGAAATCTTTTAATGCC (SEQ. ID No 35) | ACAGCAGAGAGAGGAGAAGAAATGACATTTTCCTGCAGGGCCTCAG (SEQ. ID No 36) | Control |

SEQUENCE LISTING (80 sequences)

SEQ ID NO: 1 - DNA, 27 bp, Artificial Sequence
  Description of Artificial Sequence: Synthetic probe
ccagatctctgcgtctgcaattttgtg

SEQ ID NO: 2 - DNA, 23 bp, Artificial Sequence
  Description of Artificial Sequence: Synthetic probe
ctggaacagtccctatctgtcag

SEQ ID NO: 3 - DNA, 25 bp, Artificial Sequence
  Description of Artificial Sequence: Synthetic probe
ccaacttggcaactgtacatttccc

SEQ ID NO: 4 - DNA, 31 bp, Artificial Sequence
  Description of Artificial Sequence: Synthetic probe
catctccgacctgaaatggatgcccctttct

SEQ ID NO: 5 - DNA, 33 bp, Artificial Sequence
  Description of Artificial Sequence: Synthetic probe
caatgactcgcaaccactcaccgtctacttctc

SEQ ID NO: 6 - DNA, 25 bp, Artificial Sequence
  Description of Artificial Sequence: Synthetic probe
cctgagcctcctgcagatcatggac

SEQ ID NO: 7 - DNA, 33 bp, Artificial Sequence
  Description of Artificial Sequence: Synthetic probe
gaccagcggtcagagccttctgatcattccagg

SEQ ID NO: 8 - DNA, 29 bp, Artificial Sequence
  Description of Artificial Sequence: Synthetic probe
cactcgccgcagcagccaagcaatggcag

SEQ ID NO: 9 - DNA, 37 bp, Artificial Sequence
  Description of Artificial Sequence: Synthetic probe
cacagccaatctgccacatgtgttcaatgaagggcgg

SEQ ID NO: 10 - DNA, 30 bp, Artificial Sequence
  Description of Artificial Sequence: Synthetic probe
ggtcccaagcagccagagcgagagccacag

SEQ ID NO: 11 - DNA, 32 bp, Artificial Sequence
  Description of Artificial Sequence: Synthetic probe
ggtcacactcaactgccctgaactacagccac

SEQ ID NO: 12 - DNA, 40 bp, Artificial Sequence
  Description of Artificial Sequence: Synthetic probe
ctaccaagaagaagagagtcacacgtgtgaagcagtgtcg

SEQ ID NO: 13 - DNA, 35 bp, Artificial Sequence
  Description of Artificial Sequence: Synthetic probe
ctgattcctccgtgttgtgatgtgatgctggccac

SEQ ID NO: 14 - DNA, 40 bp, Artificial Sequence
  Description of Artificial Sequence: Synthetic probe
gtttccaaacggcagctccactgggtcccctttggttgta

SEQ ID NO: 15 - DNA, 43 bp, Artificial Sequence
  Description of Artificial Sequence: Synthetic probe
gtgttatcagccacgtaggggatgccttgaaagaccactcctc

SEQ ID NO: 16 - DNA, 35 bp, Artificial Sequence
  Description of Artificial Sequence: Synthetic probe
caagtccagaggccgggtttgtgctataggaattg

SEQ ID NO: 17 - DNA, 38 bp, Artificial Sequence
  Description of Artificial Sequence: Synthetic probe
ggaggtcagggacagctttcaacagtcctgttggtcaa

SEQ ID NO: 18 - DNA, 46 bp, Artificial Sequence
  Description of Artificial Sequence: Synthetic probe
cctcggccgaatggagtttcctagttacaccatcaatcggaaaacc

SEQ ID NO: 19 - DNA, 48 bp, Artificial Sequence
  Description of Artificial Sequence: Synthetic probe
ggtgtctgaagactacacacaggtgagtgaaaattttctaccagctcc

SEQ ID NO: 20 - DNA, 39 bp, Artificial Sequence
  Description of Artificial Sequence: Synthetic probe
aagtaaggatctcagaatgtgcttgggtcagggggaaca

SEQ ID NO: 21 - DNA, 46 bp, Artificial Sequence
  Description of Artificial Sequence: Synthetic probe
gtcatggaataccttcacgtgcttagccggcccaaagtcatcgacc

SEQ ID NO: 22 - DNA, 46 bp, Artificial Sequence
  Description of Artificial Sequence: Synthetic probe
aggagcatgatgtggtgtggaccgaagcttacattgacagcactgt

SEQ ID NO: 23 - DNA, 24 bp, Artificial Sequence
  Description of Artificial Sequence: Synthetic probe
gcgacggatgctggtgcagacaca

SEQ ID NO: 24 - DNA, 26 bp, Artificial Sequence
  Description of Artificial Sequence: Synthetic probe
cctgcaggacctgaaagaggtgacgc

SEQ ID NO: 25 - DNA, 28 bp, Artificial Sequence
  Description of Artificial Sequence: Synthetic probe
gcttctccttctccttggggtgctggtg

SEQ ID NO: 26 - DNA, 29 bp, Artificial Sequence
  Description of Artificial Sequence: Synthetic probe
gtaagcccagacgctctggggagcacaac

SEQ ID NO: 27 - DNA, 30 bp, Artificial Sequence
  Description of Artificial Sequence: Synthetic probe
gacacgaggagaaagtgccatgtcacgtgt

SEQ ID NO: 28 - DNA, 32 bp, Artificial Sequence
  Description of Artificial Sequence: Synthetic probe
gtggcaagatgctgagctcggcttatatttcg

SEQ ID NO: 29 - DNA, 31 bp, Artificial Sequence
  Description of Artificial Sequence: Synthetic probe
gctggacaacctgcagtaccgcaagatgaag

SEQ ID NO: 30 - DNA, 35 bp, Artificial Sequence
  Description of Artificial Sequence: Synthetic probe
aagatcctgttccaagaggcacccaacggccctgg

SEQ ID NO: 31 - DNA, 40 bp, Artificial Sequence
  Description of Artificial Sequence: Synthetic probe
gtcagtcactggcctggaccccgaggcccgctacttgttt

SEQ ID NO: 32 - DNA, 32 bp, Artificial Sequence
  Description of Artificial Sequence: Synthetic probe
cttctggatgtgattccggtggatggggctcg

SEQ ID NO: 33 - DNA, 39 bp, Artificial Sequence
  Description of Artificial Sequence: Synthetic probe
cacttcctttcagggtggtgcttcctgacagcaccccgg

SEQ ID NO: 34 - DNA, 41 bp, Artificial Sequence
  Description of Artificial Sequence: Synthetic probe
ccactagcactgctgccccatcagctcctgcactcagcacc

SEQ ID NO: 35 - DNA, 40 bp, Artificial Sequence
  Description of Artificial Sequence: Synthetic probe
gccgccagcaatctcaatgcctcagaaatcttttaatgcc

SEQ ID NO: 36 - DNA, 46 bp, Artificial Sequence
  Description of Artificial Sequence: Synthetic probe
acagcagagagaggagaagaaatgacattttcctgcagggcctcag

SEQ ID NO: 37 - DNA, 27 bp, Artificial Sequence
  Description of Artificial Sequence: Synthetic oligonucleotide
gttttcacactgggcgaagggaggact

SEQ ID NO: 38 - DNA, 29 bp, Artificial Sequence
  Description of Artificial Sequence: Synthetic oligonucleotide
cctgagctctgcctcttccagtaacattg

SEQ ID NO: 39 - DNA, 25 bp, Artificial Sequence
  Description of Artificial Sequence: Synthetic oligonucleotide
ccgaggatacgctttcttgtgatcc

SEQ ID NO: 40 - DNA, 27 bp, Artificial Sequence
  Description of Artificial Sequence: Synthetic oligonucleotide
gcagcagcgccattagcatcataaacc

SEQ ID NO: 41 - DNA, 22 bp, Artificial Sequence
  Description of Artificial Sequence: Synthetic oligonucleotide
caaccaagtttggactcggggt

SEQ ID NO: 42 - DNA, 25 bp, Artificial Sequence
  Description of Artificial Sequence: Synthetic oligonucleotide
cttctccatcgtcttcgacgtcgtc

SEQ ID NO: 43 - DNA, 7529 bp, Homo sapiens
cctctgagcccagccctccctagcatcaccacttccatcccattcctcagccaagagccaggaatcctgattccagatcccacgcttccctgcctccctcaggtgagccccagacccccaggcaccccgctggcccctgaaggagcaggtgatggtgctgtcttcgcccagcagctgtgggagcaggcgggtggggcaggatggaggggtgggtggggtgggtggagccagggcccacttcctttccccttggggccctgtccttcccagtcttgccccagcctcgggaggtggtggagtgacctggccccagtgctgcgtccttatcagccgagccggtaagagggtgagacttggtggggtaggggcctcagtgggcctgggaatgtgcctgtggcttgaaaagactctgacaggttatgatgggaagagattgggagccattgggctgcacagggtcagggaaggccaggaggggctggtcactgctggaatctaagctgctgaggctggagggagcctcaggatggggctgatgggggagctgccagcatctgttcctctgtcatttctgataacagtaaaagccagcatggaaaaaaccgttaaaccgcaggttgggcctggccgttggcagggaagtgggcagaggggaggcccggccaggtcctccggcaactcccgcgtgttctgcttctccggctgcccacctgcaggtcccagctcttgctcctgcctgtttgcctggaaatggccacgcttctccttctccttggggtgctggtggtaagcccagacgctctggggagcacaacagcagtgcagacacccacctccggagagcctttggtctctactagcgagcccctgagctcaaagatgtacaccacttcaataacaagtgaccctaaggccgacagcactggggaccagacctcagccctacctccctcaacttccatcaatgagggatcccctctttggacttccattggtgccagcactggttcccctttacctgagccaacaacctaccaggaagtttccatcaagatgtcatcagtgccccaggaaacccctcatgcaaccagtcatcctgctgttcccataacagcaaactctctaggatcccacaccgtgacaggtggaaccataacaacgaactctccagaaacctccagtaggaccagtggagcccctgttaccacggcagctagctctctggagacctccagaggcacctctggaccccctcttaccatggcaactgtctctctggagacttccaaaggcacctctggaccccctgttaccatggcaactgactctctggagacctccactgggaccactggaccccctgttaccatgacaactggctctctggagccctccagcggggccagtggaccccaggtctctagcgtaaaactatctacaatgatgtctccaacgacctccaccaacgcaagcactgtgcccttccggaacccagatgagaactcacgaggcatgctgccagtggctgtgcttgtggccctgctggcggtcatagtcctcgtggctctgctcctgctgtggcgccggcggcagaagcggcggactggggccctcgtgctgagcagaggcggcaagcgtaacggggtggtggacgcctgggctgggccagcccaggtccctgaggagggggccgtgacagtgaccgtgggagggtccgggggcgacaagggctctgggttccccgatggggaggggtctagccgtcggcccacgctcaccactttctttggcagacggaagtctcgccagggctccctggcgatggaggagctgaagtctgggtcaggccccagcctcaaaggggaggaggagccactggtggccagtgaggatggggctgtggacgccccagctcctgatgagcccgaagggggagacggggctgccccttaagtgtcggtgaatagtgaggctggaggccggaatctcagccagcctccagcaccttccctctcaccatcccactgccccctcgctcccatgtttccacccggcaccctgatcctcacccgaatctcctttttttttttcttttgagacagagtttcgctttgtcgcccaggctggagtgcaatgcacgatctcagttcactgcaacctctgcctcctaagttcaggcgattctcctgcctcagcttcccgagtaactgagattacaggcacccaccaccatgcccagctgcttttttgtatttttggtagagatggggtttcaccatgttggctaggctggtctcaaactcctgacctcaggtgatctacctgcctcagcctcccaaagtgctgagattacagacatgagcctccgcgccttgcctcctcacccacctcttcactctgaatcctcatgaggcttctcagccctggatttcctgctgccatcctcacccagcacccacaactagcgcctgggcagggcagggctggcacctctcaacgtctgtggactgaatgaataaaccctcctcatccacccctatttatctccatcaccatttccccctctttcttgttcctggaaacggctgctgagtctccatcggccaaacttatctgccctgtgatttctttgacaattctccttttcccccagaacccaccctgggttgaccagagtctgggaagaaggacaagagaacccggcaaactccctcctaggattaactttgtaaagcacccttgccctgtagctgcaagggctgtggaacctgggcagcccgcaaccacctttagctctgggccccccaggccagcctggagcatggctgggtggggccaccagcccatgctctcaggcgggcctgtgatctttcccagggcacatggactgtaggctggccctggcccacaccaccacactctccccagccatggacagaggcagccagaggcctcacggtttctcctccgagtttctggctgggtgtagttctcagaaaccccagtgcctgcgtgtgtccactcgtgggtgtggtttgtgtgcaagagctgaggatttggcgatgcttgggaggggtagttgtgggtacagacggtgtgggggtgggaagtggtgcagagactgaagagggtcaacctgggcatgggggacacagggactgctgagaacgtgcgtgtcatctttgctctgatggggtggacatagcagaaaatctaactctgtctgtagccccatacagaatgccagggtgagcacagtggctggtgcctttaatcccagcactttggaaagttgaggcaggaggatcgcttgagcccaggagttcgagtctgaagtgagctgtgattgcaccactgcacttcagcctgggcaacagagtgagcccctgtctcaaaaaagaaaagaaaaagaaagccaggcttcatggaaagatcgtatgtgtgacccaaatatgagttcttcagctcagccatggtaatcccttccttgaagtctccatttctgcagtacacatgcatgtgcgctctctctctctctctctctctcacacacacacacacacacacacacacacgcgcgcgcgcgcgcgctctcctgcgaacagaggcagggggagaggggtttgccctggtctcggggactggtctggctggcgcttccccactgcacgtttccaggtttagtttgtctgtgtctcctcttccatcccaggggctgagccccttccatcctccaagaggaaccagtgagagtgagtgaaggaggggcctggagccagggacttcccctgtggggcctgggtggagaggggagaactcaatggtgctgcctttgagaccagcccaggctacagcccaggagcacacatgggccagggcagttggtatttcccgaggacaaagaggaaattttcaaagaggaagttgttgagttagagcttgcggtggctgagagcagacaggttgacctgcaaaaaaagacaggggaggcatgtgagtgtgacagccctgctctgtggcctgggcaggagatgggggaaagggtcaggtgggggatgggctcgtgcagtgggagaggagacggagggagggagcgggaaggggcttgcttagtgggtgggaagagctgagctcggatggaaccagcttctaccagccaggctgggcacccactgggctgcatctggtggccttttctgattgctatttggactcactgcagctgcagaatgacagaggccatgtccaaaatcccttagagacactgttgtcttagagttgttaaaataagagcccccatatcaggtttagaaaatactgtcaccgaacgaacgtcgctgtcctcagctccacctccctttcctttgacagatatggttgttttctaagccaggactggttttagtcaggtcctgggcgaatcctgaaaaaaagaggtagtacgggtaaggaaggcacccaacagggctttcacaatccagaaaatatcaaaatataagtgttaaaagagaggcacaggccgggtgcggtggctcacgcctgtaatctcagcactttgggaggccaaggtgggcagatcatgaggtcaggagtttgagaccagcctggccaatatgatgaaaccccgtttctactaaaaatacaaaagttagccaggcatggtggtgtgctcctgtaatcccagctacttaggaggctgaggccagagaattgcttgaaccctggagtcagaggttgcagtgagccgggatcatgccactgtactccaggctgggtgacaaagtgagactgtctcaaaaaataaaaataaataaaataaataaaagagaggcacaaacagtgttatgaatgcaccaaggaaaatggtgcattcataactctcaggtgaagcctaccaagccatgcgtgtgtgcacatatgtgtgtacgtgtgcatgtgcgtgcgtgcatgtgcgtgcgtgcatgtgcctgtgtgtgtatgtgtgcacatgtgtgtgcgcatgtgtgtgtgtgcgcgcatgtgtgtgtgcatgcatgttctcccatgcatgtgtactgtggcaagggagactttgaggaagagattccagtggctgagcagaagggctcgcattgccctggcgaaaggttggaaggcttcacctgagagtgtgtcgtggcctttgtcatatccactgcttgattcctttctttaaaaattatttttattgttttctacatatgagaaccaccacacctggctaatttttgtattttttgtagagatggggtttcaccatgttgtcccggctggtctcaaactcccgggcacaagagatccacctgcctcagcctcccaaaatgctgggactataggcatgagccactgcacccagccactgcttcattcctggtggctgctgtgcctggcatgttgcagatcctccatgaatatgcatttgaatgaatgaatgaatgaatgaatgaatgaatggagatgacgcctcagagattctttcttttgagatgaggtctcattctgtcacccagactagagggcagtggtgcaatcacagctcaccacagcctcaacctcctgggcctcccaagtagctgcgatcacaggtgtgcaccaacatgcccagctaatttttttttttaatttttaatttgtacagacagggtcttgctgtgttgcccaggctggtctcaaactcctgggctcaagtggtcctcccacctaagcttccccaaatactgggattataggtgtgagccactgtgcccaggcttgcctcagatatttgaaggctgggaaggattttgcaaagctgggaaaaggaaaaggcattcccagcagaggggatagcaggtggaaatacataattaaaaaaaaaaaacgtggagcagatccagcgcagtggctcatgcctgtaatcccagcactttgggaggcagagcagggaggattgcttgagtctaggagttcaagaccagcctgggtaacatagaaagaccctgtctctacaaaaacacaaaaaattagccaggcgtggtggtgcatgcctgtagtaccagctacttgagaagctgaggcaggaggactgcttgaagccaggagtttgagaccagcctgggcaacatagtgagaccccgtgtctacaaaaagtaaacatttatatatatattttttaaagtggagcagttcaatatagagtcttttttgaacaaacgtgaaatagatgtcttttttttttttttgagatggagttttcactcttgttacccaggctggagtgcaatggcgtgatcttggctcaccagaacctccgcctcctgggttcaaacaattctcctgcctcagcctcccaggtagctgggattacaggcatgcaccaccaaacccggataattttgtatttttagtagagatggggtttcaccatgttggtcaagctggtcttgaactcccgacctctgctgatccgtatgcctcggcctcccaaagtgctgggattacatgcgtgagccaccgtgcccgacaatagatgtcttttaattttctggaggaaaaagcaaagcaaaagaagcagtggatattttaagactaaaaaggaaaacaaaaaaaggagatagagcaggccagacgtggtggctcaacgtctgtaatcccagcactttgggaggccgaggcaggtggatcacctgaggtcaggagttcaagaccagcctgaccaacatggtgaaaccctgtttcaaaatacaaaaaattagctgggcgtggtggcgggcacctgtaatcccagctacttgggaggctgaggcaggagaatcccttgaacccaggaggtggaggttgcagtgagccgagatcacgccattgcactccagcctgggcgacaagtaaaaaactccatctcaaaaaaaaaaaaggagatagagcaaggaacagtaagaaaatagttgggtgcagtggctatgcggtggcactataggaggctgaggcgggcagatcacctgaggtcaggagttggagaccagcctgggcaacatagacccctatctctacaaaaaatttgaaatatgaaaaattagccaggtgtagtggtgtgcgcctgtggtaccagctactcaagaggcgaaggcagggaagattgcttgagcccaggagtttgaggctatagtgagctgtgatcatgccactgcactccagcctgggcaatagtgtgagactctgtctcaaaagaaagaacatggccaggcgtggtggctcacacctgtaatcccagcactttgggaggccgaggcagtcagatcatgaggccagtttgaaaccagcctggccaacatggtgaaaccctgtctctactaaaaatacaaaaattagccaggcgtggtggcatgcccccgtaatcccagctacttgggggtctgaggcagaagaattgcttgaaaccgggaggcagaggttgcagtgagccgagatcgtgtcattgcactctagtctgggcgacagagcaagactccgtcttggaaaaaaatttaaaaaaa

SEQ ID NO: 44 - DNA, 4650 bp, Homo sapiens
ttcctccctcccgccggccggggtgcgcgggcggcggggcggcccgcgggccatgcgttcggcgcggcccagcccggccggccgggggcggcgccccgagcccgggccccgcgcggcccgcgcccccggcccccgctgagccccgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggtgagtagggccggccgcggcggcccgggctggggggggacgcccgcccgcacccgcggcccactcggcgccttgtctccgcaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggtgtgcacggggcctcggccgcccgctaggccgtggggagggagggacgcgacggaggtggcctggccgtggctggcggggagggaggcggctgctgaggctggggaaggggagccactcccagggcggagggaggaagcctctcccggttaccagggagcaaggggtggtcctttgtcgaggaggtgggccttggggttgacggaagcttcgcgtgggaggaggcggcggcggcggcagcggctgctgggctccaggggagggatttcctgcttaagtgtcgctgtgacggcctgggctccgggaggaggcgcagggatcctcggaaaggcctgtggtgcggtttggtggatttggggcgcaccacctccgccctaaccccaaccccaacgtgtccccaggccggatcacctcaacagtcacgtcagacaagtgcactcaacagaacggcccttcaaatgtgaggtaggaagcccgcctcctcctgtcttggttttcatgattttgatcctcatggtagctgtctgagtcagtctctcagaccccctttttctctctcttctttttgcctttttgctccattttctcatcccttcttcaaggcctcatcatgtcactcccatttcctacagatcaaagatccccaaggctctgattcctttaatctcttgctcccccctccccagcccaccaagctttaactctcctgtgacaccccccacgcccctcccccctcctcagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtacatgccgagggctgccgggagggccaggggcagagggtgggcgcctggccagacgccttgccacggatacgggttaagggtgctgtagccaagagctcgtggcgtctagattcctacaagaggtcaagggagcagcggggggacacctgaatgaacatcattagactctaagaagtcctggttggaagagatgatctgccagagaggttgaacctcctggtaatgtgtggggaaagcgggagtggaacttggctgctctggggaaggagtagtcaagaaagccagttccaggggtcacaaggcaaggtttccgctgcgcagccacaaggtcttgtctccagctcctggggcaggtggagtacacgggccgggctttaccagcacgcaccctgcacgggtagcagagaaagctgccttcagtcagactcaccggttaactgggttgagaccgcggggcactggagggaaggggacacagccgtctctgctgagggtcaaccctgcaagtggctaggagtcagtgtctcgtcatcctgggagaggtctcccggccatggagaatgagttctgtaggtaccaaggctgagaagcgggcaccacacaagccaggccccaggctcagggaggggctgtgtctaccagccccaacagagcagttggccccaggctaccaaggataccgtgggaggaggacagggccatctgaggagggcatcccccgcctaggagatcagccccgtctctggggtctccgcctggctgacccccgccccatcccaatccaccccccaataggcttcaccacggcagcatacctgcgcatccacgcggtgaaggaccacgggctccaggccccgcgggctgaccgcatcctgtgcaagctgtgcagcgtgcactgcaagacccctgcccagctggccggccacatgcagacccatctggggggggccgccccccctgtcccgggagacgccccccagccacagcccacctgctgagggggacccccgcacccaccaggcaaggcgtggggcatggctggggggcgggatggggggtgtgggggacaacggggctcaaagggcccaataggggatctcaggaaggcgagggatgcccatgtaccactcaggctagggagacttctgggcacagggaggatccttgagaactgctctgtctgggtgaggatgcaggctgaggcctctggggtccagataggaagtgagcaacggctgtgtcccaggggaagcaggctgggaaggtgtggggtgagggcaaggctcttgccattcagatcgcgctgtgatccgtggtgtttctcctgtgcaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctgtcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctgtttctggctctggattgaa

SEQ ID NO: 45 - DNA, 18360 bp, Homo sapiens
gagaccgggacgagaccggggctgtggtgcggagagaggctgagacggagaagaggagaggcagagagggcgcggggaccgtcagcagcaccttagctacaatcgttcagctattctcggaagagagaagggagagggaggaggccggggcgggagtgggggctgtcaccctcggaccccggcgtgagaggggccgtgcggccggacgtcctcggggtgggcccccagtcggtggccgaagacctacagctcaggcccctgggtcccaaatttccaggctttgcccctcctcctttctcagatacccgggtaacagtcctcatagtccagatatccgggactcgggtcccaacctctctaaacctgggtctctgtttcatagaatttcaaatatcaggttcaggcccctgcgtgcaccagtatccggggttcattccccgggcgttcaaatatcggattcagtctccatcccgttcagatattcggggttcagaccccacaatcagaaatccggaattcggcagctgtcgccctcgacgagggggaggactggaccgcgaggtcagattaggttgtcaccccctcccctccaggggaggcttcccgggcccgcccctcaggaagggcgaaagccgaggaagaggtggcaaggggaaaggtctccttgcccctctccctgcttggcagagccgctggaggaccccaggcggaagcggaggcgctggggcaccatagtgacccctaccaggtgagacacggggtgcaggggcgcgggtccctgtgtctagttctgagaagaaagggtgcgcctttctgagaagctggacttgggtaggccctctcaggatggggaagcccagctgagcgagtggtcagcctctggctagccttgccttctgttgccacccccttccccttcctcttcccttcattgtgtctggttggtgggggacctcaggtgacagggtctctgatgtcaccggcgttcacaccctagggtgcttcagctaatcagatggatttgcacttcagtcttctctccttcactttgcccctcacagccacctctcctccctgatatgtcccgttctcctggctattctgtggttttgattcccatgcctctgattcccatggtgggtctgcttatctgcttttcaggcctggtctggttggatttcttgtccttgcaaggaagtgtgtgtatatgtgtttgtgtgtatgcgtgtgtgtgtgtgcttggaggtgcctggcaatgttttcccccagctgcagttaccttccaacctcttgctgtgatggtgtcaataatctcatccatttgtcaaacgatctgtcttttacaaagtgctttgacagccattctctcatgtgacatccccgcattcaccctgtgggggcctcttttattggcatcttcccattttacagttgagaacgttgaggccgagagaggttgcccaaggtcacacagtggcagaaccagaatttgaactcaagtcctcaatcacatctttccctgatgcatgcctggttcttgccatctcttttcctctgagtttgggctcggccaggggtccctaggagtccaggctggggtgaggtttaagaatggggatgagatgagcttcctttccaggagggctctactcagaagcttttcctgatgggagcctctggcttttgcctctgcctcatggagttttctatccactgtgaccttcatctttaccccaatcccagggtttggcctggattcctgagagggctctctcctgacaaatggtagcactagtggcatcttttaactgttcaagccaagctgttggggtagaatgatcccccaaaggattaaagctttgtggggaccttggaggcagggaaggaaaaatccatatgctgagtgtctgcatggtgttcctaagtatgagatctcattaaaatcttaacaacagctccatgctgtaatccatttcactgaagagaagaccaagaactggaaggaacttatttaaagccctgttgctgtacattgcagacgggatgtactggtagcatagcttaggaacagatagatacgggtttcctcatctgtagaatggagataacattgttcgttttggaaggtggttatgatttagcacagaccttggttattgttcaagtgtttgttgttattatggggaaggggacctgcatgatgttttgccagtgggtggcacccctccgtgtggcctaggttagcattctggggccttgtgttggtaaagaggtcaggaagattcctttggcaagttgagagcacctgcctttgtgtgtgggtgtgtggtgctggtgaggggtgcttggcactgttgctggcagaagggagaaaagggccggctttgagcaacctgcgagctgctgagggctgagcagagagcaatcactcagtctcccaggctattctgagccctctgcaccctgggggcccactggagagtcaggctccctccttgccctccagcttccagttgggctgagacaaaattaacaacacaacaggaaacaatgcatgacagaataaattacatgctaaaattgttaggtgcttttgagtagctagaactctgccccaggagtccagctctgctgaaggctcctttgtgcctaaattctgacaagtgcttaggctggagcctgtcttggaatctccttgagggttttggttctggtatcctgcaggaactttctccgggtgtttggttgggtgccctaggtgctcttcccaatggctggagtggtcaggacaggcttcctgcaagaggggagctgagcttggggtgacagctgagagagtaatggatacaggcctaaccggggagccgaaggtcctgttctctgaccttggagaagtcctttttcttctctgtgcctcagtgacctcacctaggaaatggtgatcatgattctgccctgcctgtttcgaagggctgctctgaaatcatagtgatggaggaccagctttggacaaggcacttaaccttgctgagcctgtttctttatctgtaagataggggaaatcatagtacttgcttcataaggttgtagtgaggactgaatagagataatgcacgtaaggtactcagtaaatgttatttgtaccctgcaaatgtcctgtacctgtgtgtgatgcttatgcagttggacaggacaagtaaggtggcccagagcacagagaggccctcatagccagatgccatttatatccctattcttcccattctagatctccccctgacttttttgagagtgactttgcgggctcctctgggccagtacccacttctaacaatggacggatttccaccgcctccggcctggccatttcctgttctcttccagggtgtgagaggttgagggaggagggggcctcagcgccaaggggaacagaaaggtgcctggaaacagttggggtataggacttatgggacaggacacttggggctctggagtgctggctgggaagcagaatgttttatccttgaggggagatacaggggctatagggaaatgagaacttgttgagcactgaagggggtggtgaggatacttagcttcccagaatcttcctagcagttttagggactccagggacccagcccgcgtgatctggttgccagggcaacttcattttttggagctttgatgttgttcctaatctccccctccccttcctcagcagtgcctcctcctcatcagggaatgaggggaggagatggcagaaacttgatgggtcccttcctctccctgaaggctcaatccttgatctctaagggtcccatttccattcctcaggccaggccccactctcagggcccccaggggccaccatgccagctgggggccgggccgggagcctgaaggacccagatgtggctgagctcttcttcaaggatgacccagaaaagctcttctctgacctccgggaaattggccatggcagctttggagccgtatactttgtgagttgggtcttgggagggtgtaatagggatggggactcttcctatccctgtggacttcccaacagcccttgcacactactccatcacactggtctttcctgccttctcttgctgggccagcaagtcttcccatgcccggctctcaatggggccttcaacaccttctggtctggtcctctaggcccgggatgtccggaatagtgaggtggtggccatcaagaagatgtcctacagtgggaagcagtccaatgaggtgggccaggtgcaatacagccaggttggggacaggggactcctgtctcaagatgcaagctgggtaacctctgcctaccctgaccccctagaaatggcaagacatcatcaaggaggtgcggttcttacagaagctccggcatcccaacaccattcagtaccggggctgttacctgagggagcacacggcttgggtgagctggtgccagattctggcctgatctttactcctattcatgcccgtccttatcgtagtccagtctcttaggtggtccctgttcgtggtgctgttgtgggatcttgggaaggaggaagtctcttttgaccgctttagtcctcagacatacccactgagcaaaagcctggctcagtgacacaggctgttagcaggtgggacaggtcactgtgggctggagaaggtggagattgaatgggagtttgaagggattcagatgggcagtggtgaatgtcttgggcccagactctagaaactctcccaccaccccctcattgtctccagttgcgcttcctccctgtcatcaccccggggacatagcttgagtacaggacagtcaaggaagctctgttttgagtccctgcccaggagactctgatctctgacccttgtctcttccttagctggtaatggagtattgcctgggctcagcttctgaccttctagaaggtaagtgactgataggccaataagtggagaagggagaagagcaggggagccatagggaagggttaaggggagtttattccagtcccacccttgcgctccctcgggttgatgttcttcctcactctccagtgcacaagaaaccccttcaggaggtagagatcgcagctgtgacccacggggcgcttcagggcctggcatatctgcactcccacaacatgatccataggtacaagcagcaccggcagtgcctgggaggggagtgctatctgcaccacctgtcacttagctgggctgcccctgcctagctttcttgagacacatgtctcatccctgtactttgcctctggcagggatgtgaaggctggaaacatcctgctgtcagagccagggttagtgaagctaggggactttggttctgcgtccatcatggcacctgccaactccttcgtgggcaccccatactggtgagtgagtgagtggtggtgagtggagagacctcccagggatgttgggagtaggagtgacagggtctcggcgggtgatttgcctctctctcctgaccattctcctaggatggcacccgaggtgatcctggccatggatgaggggcagtacgatggcaaagtggacgtctggtccttggggataacctgcatcgagctgggtaagaacatcctccctgttccctcatcatcttttccattctttcctgttagttcccagactccggactacccccttctcctagggatgggatcccaggcctccaagttcctgtccgttgtgactctaccctggagcccaatacaggcagctggcaaattctgccagctcttaggcctagagattttgtagcattcatctcttcctgtccactaccctggttctgaatcttttcttagtgcccaccatgtgctgtgccatggactgtgattctggagggatagcagtgaatgaaaatcctgccctcatggaacttacatttgatttagggaaaccaggcaggcatgttttctttcaatgtgatgaacgctgtgtggagaagttacaggagcggttcaaatgtaaaacaggggacttgacctagtttaggggctgaagaaggcctccttgtaggagaatattgaagccaacctgcaagataaataatagctgtttgcagaatgtagggaagagctttccaggcagagagaacagcatgtgagaggcctagaggtaagtgcaggcctggggaactgggactagcttcagttatttggaacctagcatgtaatgcagagaatattgaaggataaggccagagagttaggtccaagtgagttcctaaggccttgaagccatgccaaggttctcatctctgtcagccagcactattgaaacaattctttaatgaggtaggtaacctttataaggcttccaacacaatgccaggcacaaaacagttgcctaagagttgctgttagtttctcttatcaacagcctcctgcagtgatctctccagtctcttctcccttccagtctgtcttaagtactgatgccagagaggtctgcctaagctcagtgctgtcatttcactccctgtttggagccatgagtggccccctgttgccttcaagactgaagccatccccatccttcctcccaccaacctagaggctttgcttcgtaaatgctggccctttccttcatgggctccaccctctgagtgtgtcatgaactcttccacttccttgccttggttcgtattgggtcctctgcccgaggtcagagatttggacgagcccttctcctccatcttcacagtctccatttaccattagatgccaggcccagacagttgatgaaaaatgtaagaaacggacccaagtataagaaaaagctagatctgtccattttatttctagtttttggaagagatgtggatacagagaaatattactctactattgaaaaaaatatatatcagtctgattataaatgtcaactcatactaagtcaatatcagggaagcagtgtggagaaggatgtggcaaactggagattgctgtttccatagaaagagggcagctaatgcttatctccagaccattgttatgcagtaatgtagactccatttcaccagatttaattcttaaggagaaactggaaacttgtattattatttgattattacttttggcagttaattttaaaaatcaccgtttaggccaaaacaacatgacatttgtctgggctacaagggactcttagcgactcttagcttgcacttacctttctaatctcagggctttttacaaagcccttctctgaattccctgaagatatgctagcttgaaggctcactgcatactctcaacttcccagccacttccctgtttccctcttataccagttaatactttgatgttattttttcagtcctatttaatcttttagactggaggttccttgagggtggggcctaattcttgtttttatcttccccatagcaattatcaagttatctgctccctttggcacctaagaaatattagttggggtgataactgaatggctgtccttctgccttcgttactgcttttgtggatgttattttctttgacccctattccacccgtgtgcagtggagaggatgggtgttgtattttacagaggaaggaattaactgagacgcaacaggatgatgggaacttctcaaggtcatgtggcaaggaagtcaaggaattggggtttgaacccaagtcgtctcagttccattccattgtcctctaccccctgccacctctcaccttcttccctttcacctttttctgtagctgaacggaaaccaccgctctttaacatgaatgcgatgagtgccttataccacattgcacagaacgaatcccccgtgctccagtcaggacactggtgaggactgagattccgaatctgggcccaggcgttaggccatggggtatggatgcctgactcatgccttccccacccctctcccaccctcctgtgactttcaggtctgagtacttccggaattttgtcgactcctgtcttcagaaaatccctcaagacagaccaacctcagaggttctcctgaaggtgagggcctgctggcctagcattctcctggaactgtagcttgttacagccacaagaacccccagggaaattagtggttcccagttcctcctccaccaagagcttcgttgatgaattcccaccccatccccaatgcctagtggactctgtgttttacaagattttgtctaccagactgccttaatttattaagtaataaactgttttcccttcttttattaatcaaagatttatataattgccagccagagcttctggtcagcatgtgataaccagggttgccccactgatctgatgtaatgcaagccaaaagcctgtgtagccttatcatgggtaaatgtatgatttcccttaggtgttttttgaattatcaaaaatggaggggccccattcccttcacagacccatgggggcctgaggagccgtagttggaaacttcagattatgtagttggacccacttgttttataattgtaggatactgtatgaagcccagaggggcctcatgacatgtccaaggtcacatagccctttagtagaggagctggacgagaatccagttctcctgactgtccctgcctgtcagccatgcttagaggaagaagagtctgtctggggagtaggtactgggtggtacagaaaattgtgagagaagggcttgggataaggccagcatcaacccgtggtgggcgtgggccccagaagagtgcctcaggcctgagggaatgccaagggctgtgggttgtggggggaaggggagttggcagcagacctcagtgccctcttcccccagcaccgctttgtgctccgggagcggccacccacagtcatcatggacctgatccagaggaccaaggatgccgtgcgggagctggacaacctgcagtaccgcaagatgaagaagatcctgttccaagaggcacccaacggccctggtgccgaggccccagaggaggaagaggtgacccagcttgccctaacacccctctttataccccatgtgtgcctgccccctgcagttgcttggccccttccccagccctactcacaccaccatcttcccatgctacctccatgcatatgccccagggcttccccttccctgtccagcagcctacgccctgttcgcaggaggccgagccctacatgcaccgggccgggactctgaccagcctcgagagtagccactcagtgcccagcatgtccatcagcgcctccagccagagcagctccgtcaacagcctagcagatgcctcagacaacgaggaagaggaggaggaggaggaggaagaggaggaggaggaagaaggccctgaagcccgggagatggccatgatgcaggagggggagcacacagtcacctctcacagctccattatccaccggctgccggtacacagctcacccttgggggacccgagccacctgctctagaactgcctgggtcttcgccctccttccctaagtgcagcactcctctgagtctgattggctgtcctcaggtagctctctttggacccagtggcctctgagccttgggtgttccttctatctccctctagggctctgacaacctatatgatgacccctaccagccagagataacccccagccctctccagccgcctgcagccccagctcccacttccaccacctcttccgcccgccgccgggcctactgccgtaaccgagaccactttgccaccatccgaaccgcctccctggtgagtgtagccatcctcactcagcctgctcgctgtctgttttttaagtctttttaagtctagaaatgatttcctccctgtggcatgggattgagtctggattctaccctcattttctgttgctggctcctgcctgctccccttaaccctcctgcttccctcctcttcccagtggactgttttggtcatatggcccaatctgggtgtttctagcttggcaaactcttactccgtttttgtggcctgacttaactgacatctcctgggttgccttcccaggctcctctggtgagtcagatgcttcacagttgtgtgctggggaagcccagtgctgggggagccctgtgcctgtggagccctgtgctgggggtgtccagtgctggggagccctgtgccgggggtgccctgtgcttgggtggtcctgaacagcatcatgataggtttgccagattctgtgccccagagggcagggatggtgttcagatatctgtctcatgccagcagttagctctcaggcttacacacaggcctgtgttaaccctcccagcccccctgggaggggaagggtaagatcccattggagaaatgaggcacctgtggctcagaggggccacttgccccagtgcctttggtggctctctgctcctgtaagcaggcccttagtcctctcctaaaatcaactcatggcagtctttctcagttcacaggaaaaagtgtttaggcttttcataaaacatagtttttcatctatgtttttagatcacgttcctgctgagctgcatttgagcgtcaacaatccccttagaggccactgattaagtctagtatgttcttatggcctctgcttggtgctggttgtgttccaacaattcttcagatcccatggtgttgtgcggtactgtgctgagaggtcttgactgccaggggcttggctgccgggactagtttgagagccactcatagagtcaattgagaatgagacctgagatcagactttggatgaaggtgtccaagcccagtgttcttgttattccagcatcttgtggccccgatcccacctcaatacctggggagtgataggccgaccatgtttgctgaaggggaaggaagccaacacttattagatagagtccgaacttaccccacagcccctatgaggaggtattatttccccatttaacagatgagggaactggtgctttgagaagttaacttacttgagatcacatgcttggtaagtggcaaagctgggatttgatcccaggtatgtctgactcactgtttcaaattagtatggattgttcctacttttgtgccaggccctgtgctcgccaccttttatcattcggccacaccaacttgtgatgtagataatatcaccattatccagttgaggaaacaggctagagtggccgtgtgtgaggaaggtgttaaatgagaatgaaacccatgagttgaaaacccatgctcttccccacggaagaccccttgtgttaattaactaggggccaggctgagccccagctctcaccctctctccttccccaggtcagccgtcagatccaggagcatgagcaggactctgcgctgcgggagcagctgagcggctataagcggatgcgacgacagcaccagaagcagctgctggccctggagtcacggctgaggggtgaacgggaggagcacagtgcacggctgcagcgggagcttgaggcgcagcgggctggctttggggcagaggcagaaaagctggcccggcggcaccaggccataggtgagaaggaggcacgagctgcccaggccgaggagcggaagttccagcagcacatccttgggcagcagaagaaggagctggctgccctgctggaggcacagaagcggacctacaaacttcgcaaggaacagctgaaggaggtgagctagggctgcttgggggcggagccgatggcgagccaggtgggtcctgaccctgcttccctctgcactcgcccaggagctccaggagaaccccagcactcccaagcgggagaaggccgagtggctgctgcggcagaaggagcagctccagcagtgccaggcggaggaggaagcagggctgctgcggcggcagcgccagtactttgagctgcagtgtcgccagtacaagcgcaagatgttgctggctcggcacagcctggaccaggacctgctgcgggaggtaggcatcccaatctctgttcccctcccgctcactcgtggatcccagggacccacccttttccattttcctcattcttgtcttctttctccttggccctcgagtgttacagttcagctttgcttcagtgccccttttacttctcatccccaacagaccctgccagaatttccttaggcctcttttcccaggccagggaggagcttgcctcccctacaccctcatctcctgccatccccagctccctctgccaaggagccctggcccctcacttccttgatactgaccaggccctgggccctgtgtttcttccgccatccccagctccctctgccaaggagccctggcctctcacttccttgatactgaccaggccccgggccctgcatttcttctgcctcaggacctgaacaagaagcagacccagaaggacttggagtgtgcactgctgcttcggcagcacgaggccacgcgggagctggagctgcggcagctccaggccgtgcagcgcacgcgggctgagctcacccgcctgcagcaccagacggagctgggcaaccagctggagtacaacaagcggcgtgagcaagagttgcggcagaagcatgcggcccaggttcgccagcagcccaagagcctcaaagtacgtgcaggccagcgccccccgggccttccactccccattcctggggctctgggcccacccaacacaggcacccctatagaacagcagccctgctcacctggccaggaggcagtcctggaccaaagaatgcttggcgaggaggaggaagcagttggagagagaaggattctgggaaaggaaggggccactttggagcccaagcagcagaggattctgggggaagaatcaggagcccctagtcccagtccacaaaaacatgggagcctggttgatgaggaagtttggggtctgcctgaggagatagaggagcttagggtgccctcccttgtaccccaggagaggagcattgttggccaggaggaggctgggacatggagcttgtgggggaaggaggatgagagtcttctggatgaggagtttgagcttggctgggtccagggcccagcactgactcccgtccctgaggaggaggaagaagaggaagagggggctccgattgggacccctagggatcctggagatggttgtccttcccccgacatccctcctgaaccccctccaacacacctgaggccctgccctgccagccagctccctggactcctgtcccatggcctcctggccggcctctcctttgcagtggggtcctcctctggcctcctgcccctcctgctgctgctgctgcttccattgctggcagcccagggtgggggtggcctgcaggcagcgctgctggcccttgaggtggggctggtgggtctgggggcctcctacctgctcctttgtacagccctgcacctgccctccagtcttttcctactcctggcccagggtaccgcactgggggccgtcctgggcctgagctggcgccgaggcctcatgggtgttcccctgggccttggagctgcctggctcttagcttggccaggcctagctctacctctggtggctatggcagcggggggcagatgggtgcggcagcagggcccccgggtgcgccggggcatatctcgactctggttgcgggttctgctgcgcctgtcacccatggccttccgggccctgcagggctgtggggctgtgggggaccggggtctgtttgcactgtaccccaaaaccaacaaggatggcttccgcagccgcctgcccgtccctgggccccggcggcgtaatccccgcaccacccaacacccattagctctgttggcaagggtctgggtcctgtgcaagggctggaactggcgtctggcacgggccagccagggtttagcatcccacttgcccccgtgggccatccacacactggccagctggggcctgcttcggggtgaacggcccacccgaatcccccggctactaccacgcagccagcgccagctagggccccctgcctcccgccagccactgccagggactctagccgggcggaggtcacgcacccgccagtcccgggccctgcccccctggaggtagctgactccagcccttccagcccaaatctagagcattgagcactttatctcccacgactcagtgaagtttctccagtccctagtcctctcttttcacccaccttcctcagtttgctcacttaccccaggcccagcccttcggacctctagacaggcagcctcctcagctgtggagtccagcagtcactctgtgttctcctggcgctcctcccctaagttattgctgttcgcccgctgtgtgtgctcatcctcaccctcattgactcaggcctggggccaggggtggtggagggtgggaagagtcatgttttttttctcctctttgattttgtttttctgtctcccttccaacctgtccccttccccccaccaaaaaaagaaaaagacaaacacaaataaaatatctgagcggaactgtgcctttggcccaggctgcctctgtctgctttgtcctgccgcctagcctccccggtatgcccccaggctgaccctcggcccggctccatgacctcttcaccccatctccgttatctcagccccctcactcctccagcctcatgctctctgccttcatagcttcattgcaccatgaccaccaccggctctggggtctgggcccctgtagaacttcaccgaacttcttggtcccacagagcgcctgtttgcgggttccttccagaggtcttagtttccaggcccttggtctcctcatcccttgccttttctcccaaccatggctgcaggggaccaaattgctctcctgcatcaggcattaccctagtgggttgggggacggggctgcagaccctccacagtagggggtgctgagctgggggcaaccaggcggagtatgaaggctgtggcagcaggattgagtgtgggcctggagtgggagctgagtgtgtgaggggccgggctggaatgcggatctggtcagggtggtagctgctggccggttgaacttgtcaggccctttctggccacctcctttgcccctttctcctctgcggcccaaaatggggcagccccttcttacccatttctcagctcggtgcttctcctccttccctgccttcctccctgagctgctggacctgggacttcctgtgtctgtccttagtcgtgttgctttcttcatgggtgttttgtgtgactggttcttctcgcttgttctcgtgcacgttctcatatttgctcacgtgcttctgtctctaggtcacagtctctccctctttgcctggtcagagcttccaagatcctcagttccctgtccagtaactccgatgttctttctcgtgggtatcgcacccaactccgtgcacgtgctcttggaacctcttgtcttctctgcatctcttgcccatcgagaccttcctgatctctctcaacacgatcccacctctccatgtctgtctgtctgtatacagctccccccaccccctctgtctaacatgttttctgtttctctccctctccctgtctctgcttctgtctcctctcctcttctctctcttctccccatttcccctggttgttcctcctcttcctcttcctcctcttcctcctcctcttccccgctgcccccatctccccttgatccgtccactgcatagtctaaggagctgcagatcaagaagcagttccaggagacgtgtaagatccagactcggcagtacaaggctctgcgagcacacttgctggagaccacgcccaaagctcagcacaagagcctccttaagcggctcaaggaagagcagacccgcaagctggcgatcttggcggagcagtatgaccagtccatctcagagatgctcagctcacaggcggtgaggcctggggtccagggagggagtgcgctagaggccaggctctgtactttgctttagagaaatggacggtgcagggcatgcacagagctggggcttttttacttgggaaactcacatactctccctctgttcgtgttctccacaatgatttatttcatattctcctcagtggttttattctttctcttagtattttcttaaggtcttgacaaagccatgtgcctattcccaagaaccaccaaggaaaagagtggctattatttttttcctgggcctgagttagtttaatgggtaaacagggtgcagattaaagtgagtgtggccctcaagcccatttactcagacttctggaggattttgaaagttgctgttctaaaaaaatgatcacacctaacactggaatgggccacttaaaatgtgcggagagggtggagagtggaaacgccccacccaaggctgttctctcacccagtcccacctctcccaggtaacttgttaataattaactgtattttgtgttttttcagtgcacattttgaaaaattatatgaattttaaacacagatggaatcatactttacatttactttctgtaacttcttttttccacttaatatttcttggacatcttcccctgtcagtacacctgtctcattttttttacagcatagaattttccatggtatggctgtaccataatttatttaacccatcccttattggtggacatttaggttgtttccagtattttgctatcacaacgcttccgtgaacacctcgagcacatgtgcaagtatacctgggggatagattctgcagtgtaattgctgtgccacagggtatgaccatcttccattctgatagatgttgagaccgctgcttcttgaaaccttagggcccaggcctacctggggcaggggaggatagtgggggtgggggaggagatccctacaactggttgttcatcttccccagctgcggcttgatgagacccaggaggcagagttccaggcccttcggcagcagcttcaacaggagctggagctgctcaacgcttaccagagcaagatcaagatccgcacagagagccagcacgagagggagctgcgggagctggagcagagggtcgcgctgcggcgggcactgctggagcagcgggtaaggggcccagcctccaggactggggagggagggtgggctcctgcccccgactctaacctctgttccggatgccccaggtggaagaggagctgctggccctgcagacaggacgctccgagcgaatccgcagtctgcttgagcggcaggcccgtgagatcgaggccttcgatgcggaaagcatgaggctgggcttctccagcatggctctggggggcatcccggctgaagctgctgcccagggctatcctgctccaccccctgccccagcctggccctcccgtcccgttccccgttctggggcacactggagccatggccctcctccaccaggcatgccccctccagcctggcgtcagccgtctctgctggctcccccaggccccccaaactggctggggccccccacacaaagtgggacaccccgtggcggagccctgctgctgctaagaaacagcccccagcccctgcggcgggcagcctcggggggcagtggcagtgagaatgtgggcccccctgctgccgcggtgcccgggcccctgagccgcagcaccagtgtcgcttcccacatcctcaatggttcttcccacttctattcctgaggtgcagcggggaggagcagatgagctgggcagggcaggggtgggtggagcctgaccctggagggcactgagctggaggcccctgcaagggtaggggacaagatgtaggctccagctcccctcagacctcctcatctcatgagcttcttggggctggccagtggcccagggccagcttggcgataggtgcctcaaggctgcctgggagccccgcctccctaccatggtgccaggggtctccctccgccacctaggaaaggagggagatgtgcgtgtcaaatattcatctagtcccctgggggaggggaagggtgggtctagacatactatattcagagaactatactaccctcacagtgaggccctcagacctgccacagggcagagcaggtctggggcctgaggcagggagaatgagaggccaccttactggcaggaaggatcaggatggggtcttggggtcaggatgcctgggtctcttcccgtaactgtctgacgtcctgtgccgtcttgtcctttatctttttttttttttttttaattgggatcagggctggggcggggaaacaagggaaggaccttggaaggggctgctcccaggcctggggggcagtcgtgggagcccctctcagctgtggggctggcacagagccccaggcaagcttttaataaactgttggttattctaacag

SEQ ID NO: 46 - DNA, 6127 bp, Homo sapiens
agaagctgtcggactgtgagcgccttcgaactttggaggcttggctcgggatggaggtttttttagcatggggaccagggaggactacggtgctcgggactgggctgcggcctcctcgcggccccgagtgccctgtgaaatcagctcaggccgcgtccctctagcctgcactttccctctgttcacgctgcttccctccagggcccggcctccaagtgaaggggggcggagggcggtcacctgccagaaggtctggggcgccaaggtgtgtcccgggactcttggctccgtccaggttccaggccccgccccccagcttatccctagccggggctccccaccgtgggaacggggaccagctggccggaagcgccaaactgcgtccctgtccgagccctggggatcaatcaagccgaggagttaattatgtaatgagggggcagggggtcgaggctaatgaagcctcccggggtggggagggaggggaggaggggaccgtacccaggtatccgaccccctctcggaccccttcgaggccccaggggtctccaccccagcccaactccagggccccaaagaggggaggggctgtgatcctggatctggaaggggctgagctgtgagctataaagggggcatctcgcagcaccgggggccctaagcagcgagacctgaggccagacggaactacaacatgtaccatccacgagaattgtacccgtccctgggggccggctaccgcctggggcccgcccaacctggggccgactccagcttcccacccgccctagcggagggctaccgctaccccggtgagcgttgggaccagctcctgggtaggagaataggggggctgtggccctcggctggctcctcattcttccccggcttccagaactggacacccctaaactggattgcttcctctccgggatggaggctgctccccgcaccctggccgcgcacccacctctgccccttctgccccctgccatgggcactgagccggccccatcagctccagaggccctccattccctcccgggggtcagcctgagcctggagaaccgggagctatggaaggagttcagctctgtgggaacagaaatgatcatcaccaaagctgggaggtgaggggctggccagggtccgtgtttctggtgggggtctcttgggaaaggcagagtccctggggagggggctaggactgggtggttcccgaggggctagagctctgcctaggcctagaatctgactatggcctggggcaagggttactctgtggcaggaatcaggagtcactctgtgacaagggttaagggccagtctgtggagtctgtggctgagtttagggaccaatctatggcaagggtcatgggtcagtctggggcagggtcaggaagtccctctgggttataggttagtgtgtggcttagaccagcatccagacaaggacagggggtcaagggccagcccattgaccagcatcagggaaatctggccaggattcgggatcagtatgcaactcgaataggagtcagtatatgactaggtccagggtcaccctagaggcagggacacggtcagtgtttgaccttagatgaggtctttagctggggcaggaactcaagccctagcatggaaagtcctcggccctactgcaggcagggtatattttttctaaagcaaattcatctaagagctgcagattctggtgctggagatcaggggaggagaggagggtggggacaggaagctcctagcaagaaagttagtcacccctgcttctgcaaataggctttgaggggtaggagtcatggctctgttcctaacctgctgtgtgacagatcacttaacccgtctgtcctgtttccccaaatgtaaaatgagacaagaaaaccttccagctctaagattccgccctctggcttctttttttttttttttttttttttgagatggagtctcgctctgttgcccaggctagagtgtagtggcacgatctcgtcagctcaccgcaacctctgcttcctggattcaagcgattctcctgcctcagcctcccgagtagctgggactataggcacacaccaccacacccggctaatttttgtagttttagtagagacggtgtttcaccatattggccaggctggtctcaaacttctgacctcatgatccttccacctcggcttcctaaagtgctgagattacaggcatgagccactgcgcctggccctttttcatttttcagagacagtgtcttgccctgttgcccaggctggagtgcagtggtgcaattgtggctcactgtagtcttgacttcccaggctcaagtgaccctcccgcctcagcctctgtagtaactgggactatcagtgtgcaccaccatgcctggctaattttttaatttttttgtagagatggggtctttctatgttgcccaggctggtcttgaattcctgactcaagagatcctcccaccttggcctcccaaagtatagggattagaggtgtgagccacagcctccagcctgccctctgggttctaattccacctcctttgatgtttctctgacagctctggggagcccgttgttatgtcccgttactggtgctgggcccacccctggccagtgggtagctccaggcctctcctgtcccctcccttgcacaggcgcatgttccctgcctgccgagtgtcagtcactggcctggaccccgaggcccgctacttgtttcttctggatgtgattccggtggatggggctcgctaccgctggcagggccggcgctgggagcccagcggcaaggcagagccccgcctgcctgaccgtgtctacattcaccccgactctcctgccactggtgcacattggatgcggcagcctgtgtctttccatcgtgtcaagctcaccaacagcacgctggacccccacggccacgtgaggcccaggctgggactccaggatagggttggggggtgctggaagggaggccaagggtgaggcgcagggcagggaatcactcccatttcctccctcccagctgatcctgcactccatgcacaagtaccaaccccgcatacacctagttcgggcagcccagctctgcagccagcactgggggggcatggcctccttccgcttccccgagaccacattcatctccgtgacagcctaccagaacccacaggtgagtgaccctgcttgagggggtggtggccccctgcccagaccgcagttgctttgaccctgcatgtgtgtccccagatcacacaactgaagattgcagccaatccctttgccaaaggcttccgggagaacggcagaaactgtaagaggtgggagttgttcattcatttgttcatgcattcaacaaatgtttattaatcactcactgtgtgccaggcaccgtgctggacatcagaaatgcagtggtaagtgaaaacattcattcactgactcagcaaatacttatatagtacctgctatgtgccagggacagttccaggcactggagataaaacaaacaaagcaaaccaaagccccggccctcatgcagctgatttctagtggggagagtagacaagcagacaagagaaataaataaaatgtcatctgttaggaagccattctaaagagaagagagaccaggtgtggtggctcacgcatgtaatcccagcactctgggaggctgaggcgggcagatcacctgaggccaggagttcgagaccagcctgccaacatggtgaaaccctgtctctgctaaaaatacaaaaattagccaggcatggtggcaaacgcctgtaatcccaactacttgggaggctgaggcaggagaatctcttgaacccaggaggtggaggttgcagtgagtcgagatcatgccattgcattccagcctaggcaacacgagcaaaacttcctctcaaaaaaaaaaaaaaaaagaaagaaaagaaaactctgtctcaaaaaaaaaaaaaaaaagaaaaaaaagaaaaaggagaagagaaataaaccaggaaaagataggaaggactggggtgaggtattagataagaggcctggaaaggcctcagtgggaagaagacacttgagaaagagctgaaggaagtacgggagggagccaggtgggcatctggcaaagcacactagggagtgggaacagcacgtgcaaaggccctgaggtggggctgtgcctgtggcgtggctgcagtggagtgactaagagtcaggcaggggaggggaagccaggttatgtcggacagtaaaggttccgtaaggccgtgggaactgttccaagtgcagcacctcagagctggcccctgccctcaagtagcttccagtttgtcagaagagacagacatgaaccaaggagtcactccatcaaatgcaaaagcagaactgtgacggatgttatgagggaggggtgtgtgctctcggaggtcagggaggacttccttgaggaacttgcgcttgcagtgaggcaaggataggtttggtggctcatgcctgtagtcccagcactttcggaggctgagatggaaagatcacttgagcccaggagttggaggctgcagtgagctgtgacctgtgactgtgccactgcactccagcctgggcaacatagcaagaccccatctcaaattttaaaaatgaaaagaaaaaggacaggttcagcccgtgaagaggggacagaagaggattccagagagaggctgagagtggagatggggcagaaagatgagctaggtgagactgtgccctggccttgccactgggaaggagtttccactgatactaaacacaataggaaagcatggacaaatttgagcagggacaaaattccagctctgccactttctagttatttaattttctggccttcagtttcttcatctataaaatgggtataatgatggcccctacctgacagggtccctgggagggtgaaatgcctggcaccgggtaagtactgttaccatcaccatggccatcaccatcatcatcatcatcaccaccactgttccccagggagcgagacgcccgtgtgaagaggaaactgcggggcccagagccagcagccacagaggcctatgggagcggaggtgagtgtagtcccgatggcgatggggccaggcctgagacagggatcctccctagcccaacctctcccttccctctccccagacacaccaggtggtccctgcgactccaccctgggtggagacattcgtgaatcagatccagaacaggccccagcccccggggaagccaccgctgccccggcacctctgtgtggtggccccagtgctgaggcctacctcctgcaccctgcggctttccatggggcccccagtcaccttcccaccaggtgagtgggacaggggaccaggcggggctgcgggtccctctgccctgctctgacatccctctctccatgtcaggagccccagcttcccggaggctccagactccgggcgctcagccccctactcggctgcatttctggagctgccgcacgggtcagggggctccgggtacccagcggctccaccggcggtaccctttgccccgcactttctccaagggggccccttccctctaccatacaccgcgcctgggggctatctggatgtgggctccaaacccatgtactgaaccactgctgggcccctctgcctccatcacaaacctcccgctcccttcccccagccctggagccccctcacctccaccggccccatcccccacaccaaatggccgccttgggcctgcccacccaccccctcaacttcacaccttgatttcactcccacccccctctggcttcaaagcctaaccaaggctgctgggagtccagctggggccggcttccccttcccggctctcacctccgtgtgaatggaaggggctctgcctggccaaatggggccacagaccagcatccccacttaccaggcctccccatgggctctggaggggctcaatccccacccccccacacacactggtgcaggccacaccagtctgttgttctgggaccagagtatttttgttaataaaactcaaaagccatccatgctcaggaaacattgggctcctgtgtttggccctgggcgggg

SEQ ID NO: 47 - DNA, 39180 bp, Homo sapiens
acagggcaccgagggaaggaggacgcgagggcagccaggccctagggagcagggagagtggctcgggctcagtcgcgtggccccaggtgcgcgtcccaggtgcgcggccttgacccagcagcgtccgccgtgctggccggggcctcggctccgcagcagaagccgcggtggtggcagccggcgcgggcgcagctgcccgcggctggggcgtttcatctgcgccggcctatggtgcgggcatcgccctgggccacgcgctgatcgtctccatctcactcagaaaaagttactcatacagtggtcttgtaaagggtctgaagtggtcaaattgtccctttttagaaacggatagttttaggtcttaaagatgtcctagaaattacccttacaagcccagctctgtcattttatagtaagggacactaagatcgcgtacagagcttgtcggaggggcttggtcttctgtctcacgctcagggttgtctcctcgttacaggagaccttgctcttaaacgtttcagagttcgcttttccccttgctgaattcataaaaatgtttttaatttatatgtgtttcttcttgtaggaagaagaaattgtcgagacgaataacatgaggtcatatagaatcccacttttggtgatttcaagtcaagaaagtaaaagtaaaccattgctatctttcaccttaaatatcctgtgttttattgctcagaacatccagtttttctaatactcatgatgtcagaagggaaacctcctgacaaaaaaaggcctcgtagaagcttatcaatcagcaagaataagaaaaaagcatctaattctattatttcgtgttttaacaatgcaccacctgctaaacttgcctgccccgtttgcagtaaaatggtgcctagatatgacttaaaccggcaccttgatgaaatgtgtgctaacaatgacttcgttcaagtggatccagggcaggttggcttaataaattcaaatgtgtctatggtagatttaaccagtgttaccttagaagatgtaacacctaagaagtcaccaccaccaaagacaaatttaacccctggccaaagtgattcagcaaaaagggaagtaaagcagaagatcagtccctactttaaaagtaatgatgtggtgtgcaaaaatcaagatgagctgagaaatcgtagtgtgaaagtcatttgtttgggaagcctagcatctaaattgtccagaaaatacgtaaaggctaaaaaatcaatagataaggatgaagaatttgccggttctagtccacagagttccaaatccacagttgttaagagcctgattgataactcttcagaaattgaggacgaggatcaaattttggagaacagttctcaaaaagaaaacgtgtttaaatgtgattctctaaaggaagagtgcattcctgaacatatggtaagaggaagtaaaataatggaagccgaaagccaaaaggctacccgggaatgtgagaaatcagccctcacccctggattctcagataatgcgatcatgttattctcaccagatttcactcttaggaatacattaaagtctacttcagaagacagtcttgtaaagcaagagtgtatcaaagaagtggttgaaaaacgtgaggcatgtcattgtgaagaagtaaaaatgactgttgcttcagaagctaaaatacagctgtcagattcagaggcaaaatctcatagttctgcagatgatgcttctgcatggagtaacatccaagaggctcctctgcaggatgacagttgcttaaacaatgatatccctcacagcattcctttggagcaggggtcaagctgcaatggtcctggtcaaacaaccggtcatccttactaccttcggagtttccttgtggtgctgaaaaccgtacttgagaatgaagatgatatgttgctctttgatgagcaggagaagggaattgtaactaaattttatcagttatcaggtatcttacgcacgtgtttgttttcaagttttcattccccttttgctgctctgattggggcatgatgtgatgggcagtaatctagtgaccgcaaggagtcactgtggtgttgtgagcaccctgtgggagtgttcatgggagttggagcatagtcgaaggttttattgagagggatgcatggaaaagagacaagattttgtcccgggtgatgtttactcctgctgaactttggttacattggaagcagctgtttttcttttataggtacatttgatagttatgaaacaaccttttccagattaaaaaacaatataatgtgacttagaaaagcatactttgcattttgagcgtgtaatcaggctttccattaggttgttttgttgttcctcaaagatgaaagtagaataaaatacaatacaggaagaaaacaaaccaacctgaggcatattttctttctcccaacaacattttagatttatggactgtgccttttaaagacagggtgtggaggaaatggaaactttcaagctgaaattggtacattaaaaatactagtctatgcctgaagtccttggcagccaggggtggctccaagccagcagtgcaggtttgtagtaaaagccacccttgtgtctttacggtgttattcagagggccatgatgactctgtggaaccatgtccctgagggcaggaaaaaacatggtagtcacactgtcgtttagtaaaatgcggccatgtgtgactcctcagtagataaaaaagagaaaaatcctgaacattactattgatgttcaagggaaggatttctattttaaattcgcacagtgaaattatggtattccttgggttactttttaacatgtgagcgatacttctctgggcacagctgtgtgtagtatccacttccatctctacttttgctgttctcaccagaagatggacataatagcacattggcttttctatccaaactagtcacagatctttggttgggtgctgattgcattcctggagtatttcagagattggtggctctgtaattccatgtaattgagaaataggaacagttttcctagtgcaagttctgcatatgcatgtgtcttgcactccatggagaatcatgtacaatctgttggtgtgtagaaataattactgctaattgtttttgcctttttttttttttaattttaagttcttttagagacaaggtttctgtctgttgcccaggctggagtgcagtggtgtaatcatagctcactgtgaccttgaactcttggtcccaagcgatcctcctgcctcagcctcccaaagcactgggattacaagcataagccataggctgggcatggtggctcaggcctgtaatcccagcactttgggaggcccaggtgggcagatggcctgaggtcatgagttccagactagcctgaccaacatggtgaaaccccgtctctactaaaaatacaaaaattagccgggcatggtggtgggcgcctgtaatcccagctgctctggaggctgaggcaggagaatggcatgaacccaggaggcagagctttcagtgagccgagactgcaccattgcactccagcctgggcaacaagagcaaaactccatctcaaaaaaaacaaaacaaaaacaaaacaaaaaaacaaccaaaaaaaacaacaccagcatgaaccatcatgacaggtcaattttgcctttttaaagaagaaaggaaaataaatgttggaaattttcaaaatacaattaagccattttagagttggccgaaatttaaagataatctgggtaatagggagattgagaccaaacaggttaattaagaagcttggtcaagattgctgggttagagatgactgccctactgaagctagacattttttttggaaaattatttcagattattttcgatcaaatcagaataatgcatattaagctaagagcagagaacaaaataagaattctgggtagggcttttctgagggagtagaaatgttgatgtctagaaaatggggaacttgatcttagaagttttaaaatgaccaataattgttaccaaatttttaaatgtactttcaaaatggtttattccataaaatgaaggccttatacatacagtaagcatatgtgtatttctaaatcgtacatttattcaccttaggtttaaaaggtaaatgcagtgattttcaacatttttcttaactttattgcagctactggtcagaagttatatgtaaggctctttcaacgtaaattaagctggattaagatgaccaaattagagtatgaagagattgccttagacttaacacctgtgattgaagaattgacgaatgcaggctttctacagacaggtatgactagtagaaggagatgtgaaatgaaaatatgatctgaagaactgagcttctgcagaatgatggcagtattattatggtgccctccccggggtggtgcctggtaacttactgttttttaattgaatttttaatcttaggacaacaaattactcatgtgatgctaaagccattcttagcctgagttaagaatactagaataatgagagatggtctgctgctgttttcttgactgtggcaggtttagaatgaaagtcacctgggcatagacatgggtgtgtgccacagaagaaatacatcccggccgggcacggtggctcatgcctgtaatcccagcactttgggaggccgaggcaggtggatcacctgaggttgggggttcgagaccagcctgaccaacatggagaaaccccatctctactaaaaatacaaaattaggtgtggtggcgcatgcctgtaatcccagctatttgggaggctgaggcaggagaatcacttgaacccgggaggctgaggttgcggtgagctgagattgcaccattgcatttcagcctgggcaaccagagtgaaactctgtctcaaaaaaaatggatacatcccttcttggcgctctccttccagcaagagcttgactcatcttactcagagtcctcttctttatgatagaataaagctggttgtttgaaacccatattgcctctaaaaacttcatctgccccccttgcacacacatacagttcttcgattatgttgattgccttaagcattgttgaattgctttaagcctatgtgaacactaaggagagtctatcttctgcagtgatacccttcgttgtcttgtcagtagcattcgttaagtacctacctatgtattgggtacaaaattgtactgtattaggaaagggaaatgtgagccttgggttcaagttgctgacattttagaccaaaataagcgaatcagccagctggtttctttggggcagagtttattgtggggagcagtaagtggggatgaagcgaagtgagcaggaagtgtgttagggtggggctggatggcgtgggatggggaaagttgcgggagaggcataaaagctcagtgaaggcgcttggttgtgaatggttagtggtgggacacaggaccctctgcagagcagcgcttcccacacatcagtgccagcagggtcacctgggaacttgatactcagtccccacctgacttggaaaatgtggtgcagcttccgtaaattcatatgtctgacaggcatgccaggtgactgctgcaggtgagccttgacttaccttcaaatgagcaacaaaaccaggatcctagtggctcaccgtggcactcagtcaagtgcaagtcccatccatgctccagccccatggggcctggctctggctgtccctctcgctttctgccacggccacccagccctcagtgttcttcaccaggatgagtgcattcctgtctcagagccttggactgactttcccctccacccaggtcagtttccaccacgtggccacacggcatagttctcctttccttccccgctgcgtggtgttaccttgtcaaaggtttgcctgactactgtgtgaaatacagccagcctcctgccagcttcagtttgcctcctgagttgtgtttttctttagagcggttattaccacctgataaatttgcctattcatttaattgttacgctgggaggctagctcctatggatgggatttctttcactgtagcatgcccggggccttagaacattaccaggccgacagtgtacacccaataaatatttgctgaatggaggaagaaggcactgccctaaacttgtgaagccttgaaggcaaagaccagcgaggtctgactgagccgaattcctaggccaaggttggtgtcggggcccacagtagccgaacaggctcacgaatgccgagtgagcaggagaggcttgtgggaagaagagggctgatgatcagttctctctgacctggtttgagaggtcccattttgtaggggttttgtgacgagaaaggcagggagtatatattccaagcaggtgttgagatgcccaaaccataatggctatccatgtgtgtctttattttagttatgttttcctttagattttagtgagaaattctattatttgataacttttaagagatataataatagtgttattaatacgttaataataccatgttaataattccacatttaatgattggtttggccaactaattaaaattttcttagtagcatttcattttattttcatctaactaaggtaaataaagctagaaaatagtaaaatttaaaaaaacttttttttttaaccatttcagaatctgagttgcaagaactctctgaagtgcttgaactcctttctgctcctgaactaaaatccctagccaagaccttccacttggtgaatcccaatggacagaaacagcagctggtggacgcctttctcaaattggccaaacagcgttcagtctgcacttggggcaagaataagcctggaattggtgcagtgattttaaaaaggttttgttggctattgttacagtaaaaacatttaaaatgttgatagcacatattaacttacagtagattgtatacttgattgaactgtaattgtttatttcagttgtagttagattgagaaggctggaaaagccttaattgcaatagcctggattctttcttgggttattattcaaaatttttgtcgtaataccgtactaatttccaggaccaagaaaaatcggaaggcaataggcctttggtaaattgtagtattttattttccgagaaaaatacagttttaagtgattcttatgggattttaaggtaaactatttagtcaaatttttattttagtttttgtttactaaacaaagtataatcaggcagtcttaatgtgcaagttttcctgagtttaaacgtaacaatttaccaaaaactgtgagtggcttcttttgtccttgagaagcccttgacctgtttcagttgaaaattacaaaaacttttagaattgatttcttttgcccatgttatttatataatcaaactatatcaactctagcctgggaattcactactgtggagtcgaggatgaaatgagaggatgcttttgaaaacactttaacatgatgttgttatttattttatatatttgttttgtatatttcagttgttatgagcccatccttgttggggaggtgctataaatactaatctttaatgaaacataggtgtaataaggcagacattaagaaaaatataaataccaacacttgaaaaaagctcgtgttatagatttttaaaaagtacttcaataaattacatacttgtaattaattgacttgagaagtatagaatcctcatctgtgtggtatgttaaatgtcttctaagtcctttctttatctaattgtatttcttaagtatttgatgttaaccttatatgtaacattttataagcaagtaaacattaaatttagccaccctctggctgggcacagtggctcacacctgtaatcccagcactttgggaggctgaggcaggtggatcacaagatcaggagttcgagaccagcctggccaatatggtaaaaccctgtctctactaaaaatacaaaaattagcctggtgtggtggcaggtgcctgtaatcccagctacttgggaggctgagtcaggagaattgcctgaacctgggaggtagaggttgcagtgagctgagatcgcgccactgcacaccagcctgggtgacagagtgagactccatctcaaaaaaaaaaaaaaaaatagcagccctttcttggtatatgcacttagcatagaacagataaagtaaataagatgaacatattttatctctaactttggacttgtaggaaaatagaatcctcaaggctgttttagttctagtgaaaaccactgtcctttaaggttgtcctttatttcttcattctgatggtaaagcccagcagtggaatttcagagtccctgccagccccacgctagggcagcgcctggtgcttttactctgctgttatgataaagaaacagaaacagccacattattacagaaaaaggcacattatttatgctttcttaatccttgcaggagtcactgcttagttttctgtgtttaatgcttccttttgcagactggaggctgtgtccactggggcatccccgggactctgcgtggaggtggatgaaatgggtactttggggcagtctgtagatgagtggctctcagttcagtggtggtgtgataggaatcccaccccttccccttcaactccatgatggtggcactcatctctcccacaccctctgggatgcagtgctgcttttggtttaatagcttctgcaccagaagggtgtgacatctttcactagccaagtggttctcaactgggggcatctggcatcatctggagacatttttggttgtcagtactggaggtggtgaagctaatggcatctagtgactagaggccagggacagggcactgctgagcatcctataatttacaggacagcccctgacaacaaagaattacctagcctaaatgtcaatagtgctgaagctgaaaaaccctgctattgatggtgtctaagctgctagagtcagagggcccacatggtcctggatttaatttagacctccaagcccaccttgcagacatccagagttgaactgaattcactccaatgttatcctagaatagagatgctgctggaccattctgtacactagagaaggggtctgcaacccccaggccatagaccgataactgtccattgcctgttaggaactgggccacacagcagaaggtgagcagtgtgccagagagcatgaccgcctgagctttgcctcctgtcagatcagcagtggcattagattctcataggagtgtgaaccctattgtgaactgcgcatgcgagggatctaggttgcgtattccttatgagaatctattgcctgatgatatgaagtggaacagtttcatcccgaaacacctccctcaaccccagtccatggaaaaattctcttccatgaaaccactccttggtgccaaaagcgttgactgctgcgctagagaacagcaccaaactttggcatatacatttgcaccacgtcttggtacacaaaatctgatgttttacctggagcctttgataatgacattttaaagaaataccattatttaatctaaatcatcactagaataaaaaattgagaattgcttcatgttgactaggcaatacttttctgaaagttttcctggtatttgaagcactcatgaccagggtaaaccccaacctactgtgcagccgaggaaggaagcacttgtatggagccaaaccatgtgtggaaccatttggagatgtacattcatttactcctgtgtatccctgggtgagctctcagccccagagcagttaagtaatgctccagtgtttaaaatagtgaatgtcatttctctttattttagatgaaaataatttgtaaaatctgacatccaaatgcttaaaaagctaaaagttatttctacattgtacatttttcagagccaaagccttggctggacagtcagtacgaatctgtaaaggccccagggctgtgttttcccgcatcttgctactgttttcgttgaccgactcaatggaagatgaagacgccgcttgtggaggtcagggacagctttcaacagtcctgttggtcaacctcggccgaatggagtttcctagttacaccatcaatcggaaaacccacatcttccaagacagagatgatcttatcaggtaagatgatgttagctcactataatgtctatatgtgtatttcacaatttagtaaaaggttttgttatttttttccagccaaagtagaaacattaagtccacagccaaaacagtttttaatctttttttgccccacttgtatacatttctatgactatagggaaaatgtagaagtgtgctgagattatggttgccaaaatccaaggaattttgagttagaactacaaaaacttctctggtttatgtttccaagtacctttggaagggagtattttttgtttgtttgtttgtcttaatttgagacaggatttcgcccaggctggagtgcggtggcatgatcaccgctcactgtagcctcaacctcctgggcccaagtgatcctcccacctcagcctcccaagtagctgggaccacaggcacatgccaccacactcagctaatttttgtatttttttggtagagatggggtttcaccatgttgcccaggctggtctcaactcccggactcaagcaatccgcccaccttggcctcccaaagtgctgggattataggcgtgaaccaccgccctcggcctgtattttttttgacacagacatattaacaaacttgacttaggaatatgttgttggcatgaacaagactgaatgtgaatattttcttattagtaacactttaggtaaagctattaataacttgtatattgtatatcatacatatgataattagatatacagatgataaattagaaattttcactaatttatattggcacacggatttagtgaaaatttggtttgtccaataaaagtagattttgaactaaaagtagaactaccatgtgatccagcaatcccactactgggtaatatccaaaggaaaagaaataggtatattgaagagatatttgtactcccatgtctattgcagtctattcacaatagccaagatagggagtcaacctaagtgtccatcagtggatgaatggataaagaaaatgtggtacatatacacaatggagtactgttcagccataaaaaagaatgaaattctccatggtggcaacatggctgagctcagaggacattatgttatgtgaaataagccaggcacagaaagacaaatactgcatgttctcactcatatgtgggaggtaaaaaagtggatctcacagaagtagagagtagaatagtggttaccagaggctgggaggggaagggggatagggaaaggttggttaacagatacaaaagtgcagctaggtagaaggaataagttctgttgttctgtagcagtgtaggatgactataattaacaacagtttattatatatttttaaatagaagaatggatttagaatattccccacacaaagaaatgataaatgtttgaggtgatgcctggtatggcaacacatgcctatatttctaactactcgggaggctggggcaggagggtcacttgagtccagaaattcgggactagcctgggcaacataatgagaccccatctctaaaacattttcaaaaaagtttgaggtgctggatatgctaattaccctaatttgatcattatacattgtatacatgcattgaaatatcacactgtgccacataaatatgtgcaattttatgttaattaaaaataataatagatgccaaacaaataatgggattacagtattaaaaagcaggttttgataagaaagaatagtgtaggtcttaggaaaaaaaatttggatttccttaaaaaaaacacctttggtaagaaaaattaatttggatttcctaaaatgtcacttttgattcttgatttggatttctgactcaaatttaaccaaaattgattgtgatatttgcttttaggaaagtcctgtgtttctaggaaagccaggtgctttaagaagtaagttattgaaatttttgaatcacagcagtgtcagtataatctgattttggcccattttaccttagctgtcaggaagctcagtatcttatttgtgttcaatgggaataacttttttagttaaaatctctaataagactgtttattcttaccctgttttcagttgtctcatatcttttttaccttttttgtttttactggctttacgcttttctggcttgtgagaatgtatactctgaagccaagttccagtttctataccaatgaactgtgaacccaccctgtgcctcagtttcctcatctgtcaaatggggagaataatagtatattcttacagacatgtgtggggtgcatgggaagtgcttaaagcctgggctatggggaatgcctactacatgttcattattattttaattgtcattcttactgttatacccaagttctatgacaaaaccatggttgacaagttcaaaaggcatctcatattctttctagaaagtaagtgtgctgtaaataataaaaataatgagaactcccttggttaagcagagagccttaagatgtaaatgaaactggatttaattgacttctggaaaggtaatagtattcaatatctggtaatgtgatacctggccaggaaacccttgttgtctacctctgtacttgagataatttatccttttaaaatgtttcttattcattcagtacaaatgagtgttgagtaccttttatgtgacttggttaggggttgtagcagtgaacaagagagggcctcagccatcatggggctatgtttcctggggagatagaaattaaccactatttaaagtgtgtgagaagtgctgtgataattgagggacaggctggataagttctttatagacagagtggccctggagaggtgacatttgaagtgggacttgaggatgagaatgaggtagctgtgtcagggtctgggtgcctgcgtcccggccgcgagatagcatgtgcacaggccctgaggcaggaaagagcttgctgagttggaggaactcaggagacccctggctaagatgtgggggtggacaggactgggttgttggtagcggcagtggagagaagtgaatgtgtatgaggcagtttggaagcagtaaagacaagacttgattctgatgtgggcgagaaggtgaggagtggatcaaggatggctctggtgttttgccttggggtggggcgccatccagtgaaggggattgggagaggtgttggtgctggaggcgtcagtgtgtggggtgctcttcagccgtttggttgaagctgttgtgtgtggcattggacttgcggtcaggagctcagggaatgggtctggcctggaaaaagtcaacattttgagagtcactggcatatggacaatgtttgaagccatggaactgaatgagcagcatattataaaagaatgagatctaagaatttgtgagcaaacttttacatttggaggcaatttctttactcttactttacagtgtttgtacataatgatattatgtacttcatgcttttcttttagatgtgagaccaaaatacaatgaacatgtactcaaagtgttaacagaatttgttggtcaaatgtctttgttttttggtagctaaaggagcgatgaaaaattgtctttcttaagctaagttgtgttgtaacatttcagcgttgccatctcccaaagagcatcccttagttattttgaaatattccaggtaatcttcttagcttgggcagcatccctctggctagctctgattgtaaatgattaaattatcagatctacatctgactataattctgatgtcacttacatgtttgctgtcatattgttgaatgagtgaatggatgaatgaatggatgagtgccaaaatcaggaatgatgagctgatccatatcacatttatagaatggaacatgttatgtgataatacagcataaatgtttttatctttctagttgggctttcttatcagttctgggccactccagtgatttggttaagataaattattattagaataaaatttaagtggccctcatattttaaaaaacacacttttacctttcagagtgagatctagtggctaggatgtggtcattctatgggaatgctcattcttatttggaacttggatggcattttcctccagatatgcagcagccacgcacatgctgagtgacatttcttccgcaatggccaatgggaactgggaagaagctaaggagctcgctcagtgtgcaaaaagggattggaacagactgaaaaaccacccttctctgaggtgagagtttttctaggtacctgccaaaatttatacattgaccaagttgttcccaacacttacagtaattttcttcatgaagaatatactcctttttctctgtggttaaaccagctgtggaattgaattttgtgcgtgctttgcctagaatgaaagtgctgtgtgaaatagaaggaaatgtctgaaggtttaaagtgaatttgatataactcagatccctgggcaacacacatgccaaccccatacttgacttgtcgcatgccaactgtaggagtgttggcctccctgagtactggtgagctgaactgaaacgtgagggaagccagcagcaggacggatgtgggaagcatggtaggtgggttcctctgagggaaattcaagtaggtgttaaaaactctgcaaaagacagctcaagcgaactttccaggtacacagcacatgatcttttattttgttgaaaatggtaaacatcttcaatatttattaagacattttttcctttgttgttacatagtgatgagaaaaattagtattttcagatgccactttgaaaaaatcatttaggatatacagttgacccttgaatgatgcaggggttggggtaccgacccctcagacagtcaagaatctgtgtgtaacatctgacttccccactacttaattaatagcttactgttgactggaagccctaccgattacatagtcaattaacacacattggatatgttatatgcattatatgctgtattcttacaataaagtaagctagggaaaagaatatgttattaaggaaaatcataagggggctggtacggtggctcacgcctgtaatcccggcactttgggaggccgaggctggcagatcacctgaggtcgggagtctgagaccagcctgaccaacatggagaaacctcgtctctactaaaaatacaaaattagccaggcctggtggtgcctgcctgtaatcccagctactcgggaggctgaggcaggagaatcacttgaacccaggaggtggaggttgtggtgagctgagatcacgccattgcactccagcctgggccacgagcaaaactccgtctcaaaaaaaaaaaaaaaaaaaaaatcataaggggctgggcgtggtggctcatgcctgtaatcccagcactttgggaggcagaggtgagtggatcacttgaggtcaggagttcgagactagcctggccaacatggtgaaacctcgtctctactaaaaatacaaaaattaggtgggtgttgtgacgagtgtctgtaatcccagcctcggaaggctgaggcaggagaatcacatgaacctgggagacagaggttgtaatgagctgagatcgcaccactgtactccagcctgggtgacagagcgagactctgtctcggggaaaaaaaaaaaaaaaaagaaaatcataaggaagagaaaacatatttactgttcgttaagtggaagtggatcatcatgaaggtcttcatccttgttgtctttacagcaaataggctgaggacgaggagagagaggagggcttggtcttgctgtctcaggggtggcagaagcagaagaaaatccacatataagtggacgtgtgcagtttaaacccatgttgtccaggggtcagctgtatatttatagagaaataatattgacttaaaaatcacaagaagttagattactataaacagaggttgataaacttctgtaaaaggtcacatagtgaatattttaggctttgcaggccatatggtttctgtggcaccaactttactctgctgttttagtgcaaaagcagccacaagaagtacgtatgcaaatgaatgagcctggctgtgttccagttaacttcatttgtggacattgaaatttcagtttcatacaattttcgcataccaaagtgtattattctctttatttattaacaatttaaaaacataaaaaccattcttagtttgcaggacatagaaaatcaggtggcagaccctgggtttggctgtgggccggagtttgctgaccttggtttagaatgatgagttctcatcttactccactgtctgagtgacctaggacgtggtagctggctgtgagaatgtaggtttgtggtgtagaaaattgtacacaactgaaagtatttagaatatacctttttaaaagataggaattcagtctgctttgtcacttgttattattgtcttataataaattaaccaaattattaaactactggtatatgtcttcattttagatgccacgaagatttaccactcttcctgcggtgtttcactgttgggtggatttatacaaggattttgtctcggtttgtggaaatactgcagagacttcacatgtatgaggttagagcacaggtccctgccccccaccattactgatgtgatggcgttaaacatgtgaagggacagctgtcgggctctcagcatttcctgcttatttggttagcacacagtaatataatggaggcatatttgttttgttttgtctttttgagacagggtctcactccatcacctaggctggggtgcagtggcagggttcagcttactgcagcctctgcctcccgggctcaagtcatcctctcacctcagcctcctgagtagctgggactacaggcgtgcgccaccatgcctagctaatttttgtatttttagtagaggtgagatttcaccatgttgctcaggctgatctcgaactcctgggctcaagtgatttgcccaccttggcctctgatgctttgacagtgggggcctaaagtgttgggattacaggtgtgagccactgtgcctggccaacgagggcatagttaatgtaggcagcccgctgtctcttggattagtagagagaagataggtgaagatggacagctgttctgtttgcctgtgtgttgatgaatctgtgtcccaggatggcctgggggtggcggccaccatcctggagggtgccccacaggtctgcagcctgagcctgagtctctttcagaactccttgtgagacttggcaggtccccagaaatctctgagggaccttttgcttccttttgcttccctgtcagctgtcatggattgtctggagacaatttataatcacaaatcagaaatttgtcgtatcctaaactttgtgaaattgctagatttcacttttgttgtgtttgatatttctatattgaaaatgttatctccagaccaggcatggtcaaaaatatatatatacaaaacaagaagaaaagaaaatgggatcttacaaagaggatgtgctaagctggtttcttggcctggggtctgtgaatcccaggggagtgatgggtgggctttggggaaatctgtgaatctcaaacttgcatgtgtatggggatttatgcatttttctggggtaaatcattccatattacaaagacatccatgagccacagaagattaacaaacagaatgaccgaacagtctgtacataatctagaccagagaatgttcctgttgaggtagggtgtttgtatgaggacacccctcattactttcctgcccaccccaaatccctcttgcagttggtcctgtgacctgctgtgttcccagaagtatgtgggtttgccaactgtgaccagtgctcagctgcctggaacttgaccctgtgcgactctgcactggttgactggtttgcagataacactctgcagcactcacagatgtctgtaccccagtgccagctggcagggaccgggtgaagagtgaggatgccttagggaactcatgcccactccagaaggcacctcaaagtccctgtcctgtcagttcggggtccttggcctcattgtagaatggaaagatacgcattataaataggctttaccaatcctatgggcttgtaaatatcattgcagctggattttttgtgaatctaatgaggtttctttgttattgttgcaataggaagccgtcagagaacttgaaagccttttgtctcagagaatttattgtcctgacagcagaggccgatggtgggatcgactggcccttaatttacaccagcacttgaagcgcctggaaccggtactcagtaacaaaacatatctgaaacaccttttcattttagaatcaacttttaaaatatggcaaacttaatgccttaaaatttacatgtaattagaacatgtatttcttttgttaacattcttcttttgtctgtgttcttccaaccccaaaagaataccagggatgccagcacagcatgagcatagagactggaagcttttgtcttctctttgctgattggcgagatgggcttactgtggactctgtgctggcatttaggaatcaggatctaggaattaagggaaagggagagtcagatgactcagccgtcagcaagtcagcaagtgccttcaaggaaggtgtttgttttggaaatggtgactttgttgatttgtagcacagggtctctaggtagaaagattggcgagaaagcgttcctttccctatcttattgcaggtcctttatgcgtgactctgtacttctgtgaggtgttttgctctgccatttggaagcgttgtttgaccttgagcaggcaccagtgctccctgtggtggcgatctaggggcacttggaagcacagggattctgtggccaccacagccaggcgggtgaggccgcagagcctgtgcctgtgggctaggcagcaacagtggttctttgtgtggccgccagcaggcccctccctgtctctattccagccctgcatttgagttgaatggaggggactgtgcctctgggagcttttgattttttcagtggcccattaagtgaatcagggtgatgtaggggtggaaaaaaacgaccactggttaggaaatatgacatcttgtttttattgccgtaaactgaaaaagtgccttgttacctcacgtatcagggaaagagccagtaaagctatttcctctcatggaggagggtgtggggcttccttaccactcggtgtttactgaggctgaaatagcaagagaaagcatctggtagcctagaaccaaatacagaaggagaaagcttgtgtttctgtcgcctttctttcaatgaaataaaagttcaagagagtacagatttcccctctgttcacagttctgctagggggtagacaagccactgagcttatttttgagatttgagctaagcctagttcctcctaacctctgtttccagaggtcttactggccatagctcttgttatttcattagtgttctttgatctttacctcagtctccagggaagggatcgcctagctgagtgctaattcctgcaaagtgctctgcagccagccccggcctggccagggcagaggtggagccagctgggccctccctctccgaggccaggctgccgctgcccggcaccgtcttctgccagcgaacagggtgcccttcagagtctcattctcccatcttcatttccttcagccactcaactctggatggcctgagccttcactgattttcaatttcttggtttttattttttctttcactttttatgtttctattgtggtaaaataaatttaacatccctaaaatacagcattttagccatttttaggtgtacagttcagtggcattcatggtactcatagtgttgtgtgaccattgcctctccacttaccactccaaacagaaacactgcagccattaggcaactacgccccgctttcccttccccaagccctggcgacgacgtctcatctactttttgtgtctgtaaatgtgcctgttcatttcattcatttcattgaagtggaatcctacgatatttgtggttttatgtctggtgtattttgctcagcatcatgtttctgagcttcacccgcatcgtggcacatgtcaggactccgttccttctccaggctgaacacacttccactgtagcatctgataccacatttttctagccactcattggttgatggacactgggttccttccaccttttcggccattttgaagaatgctgcatgaacctctgtttcagtccctggtttcaattcttttgggaatacctgagagtggaactgctgggtcctgtggtgattctgtgttgagctttttgaggagtggctgaactgtttttcacagtgtttacaccagtgtcacattcccaccagcaatgcgtgaggtttctggtttctctacctccttgtcaatgcttattttccatgtttctgattatagccatcctagtgtgaagtggtatctccttgtggctttctgtgtttgtttatttgtctgactctgaatcgccttgggaaatacttgtaattcctccaaacctttggctcctgtccctgtaaataaggaatctgaagcagctccatggttcttgactgcatatgagattgacctggcgctttgatgtggcccccatgcgtgggctcctgctctggaggttctcattgtgtggatccggggtgggacacatgttttcctacaaagctgcctaggtgatgtcctgagaaccactgagctaagttttcctgtaaagtcaggtacccctgaggttcacaccctttgtgaggggcagctgctgggatccactgtccacctggattacagcccggtcacgctccagcacgttgactgtgaaggctctggttgccagatgcattgaaatcctcagaataagatctaaggaaacagcctaaatctctagaagtgctgtttgctcatttgctaatcagcaaaattcaataataaacagtgggcttttctgtcaaactaaatgcatggaagccgccatgggtttttttaggagcctgatgtgtgaccatgctctctgccagactatcaagtgcatcacagaggggctggcggatccggaagtcagaacgggacaccgcctttcactgtatcagcgagccgtgcgcctgcgagagtctccgagctgtaaaaagttcaagcacctcttccagcagctcccagaaatggctgtgcaagatgtgaaacacgtgaggaaagagcctgtgggtgctttggacttaggcgcgtgtacctggtttttttggaccagaagcatcctaagagctgttttgagtgtgtgttttcttttagactcggaataatctaaaactcgttttggacggctgtgtggccattgctcccagtctccccctaacgccctcctccctgaggagactgggttgcttggtgtggtcacaccctgggttgagtgacagatctcctgaatggggcctctcagcatctgccccggtttcatttactcactggggacctgtagagcagttctggtggttgaggctctcccagggccggaccagcgaactgtcacatccccgcagttctgcgtgtgtgagccccacgctgtgtgctctactaagtgactgactttgtggtaagggaggtcaatcctcacgatgctacaggcaggttttcagggacttttgctgacctgaggctaatagatgttattctgctgctgtttcaggtgaccatcacaggcaggctgtgcccacagcgtgggatgtgcaagtctgtgtttgtgatggaggccggggaggccgctgaccccaccacggtcctgtgctctgtggaggagctggcactggcccattacagacgcagcggttttgaccagggtaactgagcaggctttctcttgtggcacccagccccgggtggacgagcagcagcactggatgggctgtcagcagtgggctgctgtcctctctctgtcctctgctcacagtggaagatgctgtgggctgggggatgtcttcctattcttccccttatcaatgataaggagtaggtcaggggtagttgtcccacagggcctggctctgatcttttttcttttataaaaacttataaaagttatggaaggtactgcacaagcctttgtacagaagtcagggggacagtgtgctcaaccccacggacacccacttccattcagtgttccttctgttctctcctgccccttccctgggattttagaagctggccccagatatcctctcaggggccctgcggcccatgctagtcgctttcgggaacagccactgagccttccgcccttgggcctggcaggactctccctgtgcccgggctgcagggttaccagtgttaaaaacactgatattttcagatgtgtgaaaatcaggacatgatttcagtattccccgagtgttcggaagattaacaagtactatagaaagacaaccacaagataggagtttacaaagcccaggttctttctgatgagtgttgagattcatctacataatatctttattacttacagggaagggtgatgttattggggaagacgtgcaaatgccagtgaagacagagagatacagtaggcctgaaatggttagaaatagaagaatagaatgcacattcaaggccccgagagacgtggaaactggacactcgctggaggaggaagcaggctgggacgtgggagcgctgaaatgctttcagttgagccatgagcctgaaaaacacacgattcctttcccagagtagaaactatttttccctgattaaaatcgatgccgtgaaactgggctgaactctggctgccaggctttatgccacagggaattttgtgtcagagcgatctcaacctcttctgggaggtgatttctgaagtactgcaccaaaaatgatttcacttataacacaaatgcacagcatggaccacttaggagttaaggaacgaaccaggcacggtagcttacacttgtaatcccagcacttggggaggctgagacaggaggatcacttgaactctgaagacggaggtgggaggatctcttgaccccaggaggtcaaggctgcagtgagccaagattgtgccactgcactccagtctgggtgacagagtgagaccctgtctcaaaacaaaacaaacaaaggagttcagaaatgatctggcctttatattcctgcctgatcgtcagtgtattcaccaggacggaacactgactggaaatcaggtcctagctccactcctggctgggaaagagcatgaagtgttctaggaagaaaagtcctcctggaagacttggcaacagccaggagtcctgagtgaaccgctgtccttttgaatccctgagacgggctgcagggatgaggggctagaactgacaggaagacaggacagagagcagcacagcctcagaagtgcaggacagaggtgacccaggcaggcatgacgggctgtggcttcctgccctctgctctcacagcacccctgatcccactcactgtggtaccacgcagatgggttggggcctgtaaatgtcaggtgggaccagccagaggagctttgctgccagtactggcatgtcaggatgggggtctggtggtcagcacctcctctggccagtggtcttgtggggagaggcatccatgtggcctcctcctctgtcgggagggctgatgtgcagagaagtacggacttggagggcagctggatgagctggggcttgctcagggacacaggtctgtgtgttgtgccaaggctgaccccctcatcccacaccagaccctgcctctgactctgtgacctcagcacctgacttctgtctctcaggtcatctcccagtcagtaaaacatttgtgtgacgtgaggaggggcactgaagtgggtgatctttaaggccagatgtctctgtaaaagccttgactatcggaagcactgggctagggcagtgtagtacccagggggatgaggtgcatcagagcagcacctgctgaggccaagaacggaggtggctgctgccggcctccgggaggtccccttagggaagcatttcttcaggggtggcccagggacctccggcatcagggcctgcatggggattctgtgccagcccagccctgctaagtcccagccttgggaacctgaggagggtatctgcctatttttcttttaaacatgtttcttaggttattcactaaagtttgagaaccactgctttgtggctttgaaatgttcatttgaatttttctatgattactaagatttttgcccttaaggctctgtatataaacaacatactgtataaaataaactgggaatggcgtgaaaacagcatttgcttctgaatctaaaatatttctattattttcttgaaattgagtgtgcagtaggttatggtggtgttttggaagaaacagataaaacagattttgtgtgtgtgtgtgtgtgtgtgtgtgtgtgtgtgaccttgtcttagggattcatggcgaagggtccaccttcagcaccctgtatggcctcctcctgtgggacatcatcttcatggatgggattccggatgtcttcagaaacgcctgtcaggtactccagtgcccctgccccacgagtaggtccttctgcacacatccgtggctcacgcccacctgggcaccgtgtgtccacagccagcagaaaccatctctgttacggtcctttgggtcatccacaggtcaagatgataacttattttaaaaatctgagtaatagaatttaagatgtaagtatgtgaagttttaaactttaatttagcctccaccttacatttagacctttcgtataaagtaccatcagcatcagccctcccgagcacctgccgtgtcgcaggcactgtgccaaggagctcacagacatgggcacatctgcctgttcagaggtccacccagctaagcgaaaagctgtttttgcaaattattactctaaaaaacaagtttaataaattgcttttatatcaattaacttttacttatcttttgagagaaagaatgtatcggttggccggtttccaagttttgtatgtactgactagtcctctggtgaacacggctctctgcaggcacagtatgacagcttgctttccctgtgacacaggcattccccctggacttgtgcacagacagcttcttcacaagcagacgcccagcccttgaggccaggctgcagctgattcatgatgcccccgaggagagcctgcgggcctgggtggcagccacgtggcatgagcaggaaggcagagtggcttcccttgtcagctgggatcgcttcacgtctcttcagcaagctcaggtaatggttcacctgcatggcaggatttgctcagaaagttaacaccgccccagtgctgtcttttcagcaactttatcaaaatacacatgtgtgtatatgtaaatacatgtatgtgtgtgcatatatatgatatatagtatatatcatatataaaatatatattatatctttattatatttattatattatatattatatattacatattacatatataatatatattatatattatacaatatacaatatataatataatatatgaaatatataatatatcatataatatatataaaatatatattatatcatatataatatatataaaatatataatatattatatcatatataatataatatataaaatatataatatattatatcatatataatataatatataaaatatataatatattatatcatatataatataatatataaaatatatatcatatataatatatataaaatatataatatatatcatatataatatataaaatatataatatatatcatatataatatataaaatatataatataatatatatcatataatatataaaatatataatatataagatatcatatataatataatgtataaaatatataataatatatatattaatattatataaattatatatatgagaataccctatccccctggccccaatgccactgttagtgatggaaacatactagggtgttagaaaagccccagctgtgcctttgccacccctgagttgacagctttcttttgcttgccctgtggctgaggcagggaggataccttctgtgttccttcaactgctgccctctatgaggccatgctgtcgcgttcctgagtgcatcctccacatccctcttcctcagcgctccccagcatggccacgctggcagaagcctggaaactgaccacaggaggaccagtctcccaccacttgccagtgggattccagccatggctctgcagctctggtacaagcagcagaacagcgcatggtgggcctggggtccatgtgcactgaattacatatacactgagcttttctccgtctcgtgatccctggagcctatttccattctctgtcacgagggaagtggctaactgtcctgtgttttgtgttcaggatcttgtctcctgcctggggggccctgtgctcagtggtgtgtgcaggcacctggctgctgactttcgacactgtcgagggggcctccccgacctggtggtgtggaactcccagagccgtcactttaaggtcagttgaggcagaatggaaagtcctgttggtaaccttattagcaactgaatcagaggccacaagtaggcatttcttgagtggctgttggcaagattgaattccttgagagcttttgggccgagggcctgggttcctgtgggcctgtcccctgcgactggcttcatcagagcaggcgggtgagaggagccccagagtgtgagcaagacagagctccatctcttatgacttgatgtggacatgatgttccatcactcctgctgtattctgtggttaggaacgagtctctagtccagctgacactcaaagggagggggtcacaacgggtgtggacaccaggagctattttagaagcttaccgataattgtacattttaaaatgacttaaagagtataatggtttgtaactcaaaggataaatgcttgaggggacagataccccattccccttgatgtgcttagttcacattgcatgcctgtatcaaaacatctcatgtaccccataaatatatacatctactatgtacccacaaaaaattttttaaaaagctcagagagtgaacacttccttgaacgctgtccactagcccagccctgctgcccatcactggtgatttgttttctcattattgagttttgagattaaaaaattatatatcctggatacaagtcctttatcagtgacatttcatcccagtctatggcttgtcttttcattttcttaatagtgtcttttgaagagcagaggtttcaaagtttgacaaaatccaacttatttgttctctagtggatcatgcttttggtgtcacatgtcagaaatacttgcctaatccaaggtcacaaagagtttctcctttgttttcttctagaagtgttatagttttaggttttacattcagttttatgatcatttgagacgccatttgtatacagtgtggggcatgcactggaattcatttgtggtgtgtggatatccacttgttccagctccatgtgtcaagaagaccatgcttcctccactgaattccctctgtatctttgtcaaaaatcagtaacccatatatatgtgggtctgtttctatatactcttcggttccattgatctgtttgtctgtatttcttgattattgtagctttagatacatcttggagtcaggtagtgtaagtcctataatgacttgtttttcaaagttgttctggctcttttgcatttttatttgaattataacatcaaattttaagtttccaagaaaaaaaaaagccagctgaggccgggtacggtggctcacacctgtaatcccagcactttgggagacagaggtgggcggatcacgaggtcaggagattgagaccatcctggctaacatggtgaaaccccgtctctactaaaaatacaaaaaattagccgggtgtggtggcgggcgcctgtagtcccagctacttgggaggctgaggcaggagaatcgcttgaactcaggaggtggagcttgcagtgagccgagattgcgccactgcactccagcctgggcaacagagcgagactccatctcaaaaaaaaaaaaaaaaaaaaagccagctgagattttaattggaattcctttgaatctgtagaccaatctgagaggaattggtatcttaacagcattattttgatcagcaaaaatgggagttgattttgtaaaatattaagaatttttgcatatatgttcatgaaggatattgagctgtacttttcttttcttattatctctttgttgggttttggtttcagagtcataccagcatcagagtgggatggaatagttggtgtagaattagtattattccctaaacatttgatagaattccccagtgaagcagtatgggcctggagattttggggggaggaaaatttaaagctataaattaaatttatttttaaacaacataaggctgttcatattatctgtttcttcttgattgcgctttgctagtttgtgtctttcaaggaatttgtccatttcatttaagtattgtcttaaagttgtttatatttgtttcttttctttttttttttttttgagatggagtctcgctctgtcgcccagactggagtgtagtagcgtgagttagctcactgcaacttccgcctcctgggttcaagtgattctcgtgcctcagcctccctagtagctgggattacagctgtgcaccaccatgcctggataatttttttttttttttgtatttttagtagagatgaggttttgccatgttggccaggctggtcttgaactcctggcttcagatctgcccaccttggcctcccaaagtgctgggattacaggtgtgagccaccgcacacggccatgtatttcttactgtattttaatatctgtagaatctttatctctgtcatgctcttattcttgatattggtaatttgtgtcttttctcttttttccctaatgagtctggcaggaggtttatcaatttactgattttctcgaagaatcagcttttggtttcatttgtttttttatttcctagtttctcaaggtggaagctatggtgattgctttgagaacttcttttctaatagagttaggtagtgctccaaatttccttctcagtgctgctttatctgaacctcacaaatttagtagttgttttcattttcattcagttcacaatactttctgatttcccttttgactcttctttgatccttggcttatttagaagtgagtcatttacatttccaaacacttgagagattttcaggtatctttctgctattgatttgtaatttaactccattgtattcagaggacatattttgtatgatttgaatcccactaaatttgttgagacttgttttatggtccagaatatggtattccctggtgaatattctgtttgtacttgaaaagaatgtgtgtttagcatttgttgtgggcagtatttttaaatgtcaattaggtcaagttggttgatagtgttgtttaagttgtctgtgtccttactgatttcttatttacttgttctataaattattgagagaatattgatatctctgattataattgtggtatttcttttctttttttttttgtttttgttttttgagacagactctcactatcacctaggctggagtgtagtggcagtgcgatcctggatcgctgcagccttgatctcccaggctcaagcaattcttctgcctcagcctgttgagtagcccgaactataggcatgcaccatcatgcccagctgattttttttattttttgtagagatggggttccaccatgttgcccaggctggtctcaaactcctgggctccacgttggcctcccaaaatgctgagagtataccgtgcccagccaatttgtgtatttcttcttgcgtttctatcactatttgcttcatgtattttgaaggtctgttataagacgcatagacttttaggactgtcatgtcctcttcatgagtctacccttttatcattatgcagtgaccccccctttacacctggtaatctttgctctgaaatcaactttgtccgatattgtcaacatgtagccacttcagccttcttttttttaatgttaacatgatacatttttccattcttttacttttgacctgttttatcttatttttaatgtggatttcctgtaggcatcatatagttgggtcttacttttgaatccaacttaacctctgtcttttaatggggtgtttggaacatttacatttaatttgattattgatatccttagctttaaatcctgatacttattttctctttgtctcagaactcttttgtcccttgtctttttcctgagtagctggaaccacaggtgcacgccaccatgcctggctaatttttgtggtttttgtattttttagagatggggttccaccatgttgcccaggctgatctcaaatccccaggctcaagcagttcacctgccgtggtctcttagtgttgggattgcaggcatgagccacagtgcctggccctgtcttatttttaaagattgcatttgatagctttgctggcttgttagctgtaactgttcattgtgttgaagtggttgcgttagtatattatatatcttaaacttatccaccttcaggtgatacacactttagagtaaaaagaacctttcaataatatatatcttcccttccagcctttgtggtgttttcatatattttacttctacgtgttatatgttctataacatattatttttgctttctacagttgattaatgagtctgtatttactcatgtacatagcatttccagtgcttgctattcttttgtgtagatccaggtttctgtgtagtctcattctcctgcttgaagaatttcctttcacgcctgtaattccagcactttgggaggctgaggtgggcggattgcttgggctcaggagttggagaccagcttgggcaaacacagtgagacctcatctctacaaaacgataaacaaattagctgggtgtggtggtgtgcacttgtagtcccagctgcttgggaggctgaggtgagagaactgcttgaggctgggaggtcaaggctgcagtgtgctgagatcataccactgtataccagcctgggcaacagagtgagaccttgtctcaaaaaaaaagaaaaaaagaaaaagaaaaaatttccatgtctagaagttctgctagtaatgaattacagtagttagccctctgtatccatggtttctgcttctgtagatgcaaccatggactgaaagtatttggaaaaaagaaaaacaataaaaagtaactacaacaataaacaaatcaaataaaaatacagcataacaactattttcatagcatttatattaggtattataagtagagatgatttaaagtatatgagaagatgtgctagaatatgcagatgcgatgccattttatatcagggacttgagcatccatggattttggtaacagagggggtccttgaatcagtcccccatggatactgagggatggctgtatttaggttttgtatgtcttagcctttatttcacctttgtttttgaaagatattttctccgtgcaatgaattttatgttgacagttatttttcaatactttaaaaatattagtctactgtcttctaactagcatggtttccaatcagagaatctttttttttcctctggctttaaaaattctggctgctttgactatatcccctgattatacagttgtgatatttcctagggtgccgttacatttgtgtgcctgggattcattgattttcttcaatctttgggtttactgttttcatcaaatttggaaaatttttggccattttttctttaagtatttttttttctcgttcctttggggactctaattaaatgtcccttaggctgctaaatgctgtatttaaacaatttttttctatattttacctatagtttttattgctgtgtcttcaagtctagtgatgtgtagtgaacaaaacacacaattcttgccttcatgaagatgacatgtagtatatatttttatcttatgaatgccatgaaagaagtgcatagggaggatatacttagagctgtgacctctccagatcagtttaagctgagcattgaaaggtaagaagtcaggcatgtcaagaacagggagaaatgtcccaggcagcgggaacagcaagtagcaagtggaagtgagggccttggggtagggaagagactggtcatggcaagaaggttagatttaattgaaaatgtaacagagtaatcggagggttttaagcaaggaagtaaaatccagtgcatgctttaaaacaatttttcatttgctatactaagaatcagtttactcatcctctgtgaagaactgtctagtttctacagaatagaagaatttctgaataaatttcttagctacatacagacgcttctcaacttatgatggccttatgtcctgataaatcctacacatcaactgaaaatattgttaagttgaaaatgcatttaacatatttatcccaccaaacctcatagcttagcttagcctaccttaaatgtgctcagaatgtgtgcattagcctacagttgggcagatcatgtagttcactgcaaaccgtagagtactggttatcctcatgatcatgtggctgactgggagctgtggctcactgctgctgcccagcatggagtatcatactgggaaaagatcaacactcagagtatggtttctgttgaatgtatatcacttttgcaccatttttaagtcaaaaaatcctaaggtgaaccattgtaagtgaaggaccatccgtatatttgtgttacacttacaaatacagtgagagagcagaagagccatttaaatagttgtcagtgacaactacaacttacttgaatggcttttcattcagtaagatactaataacaacttttaaaaatttcttttccagctggtggaagttaaaggccccaatgatcgtctttcacataagcagatgatctggctggctgaactgcagaagctgggggctgaagtagaagtctgccatgtggttgcagttggagctaagagccaaagccttagctaaaaggtatggaattggggatatttggtcatacattaatgtaagattttcaagagtataaaacatgttttatttaattttgttatcgtgcattataaacctgatagtttgacttgtcattttacagtgtctgcatatcacaaaacagtgtttgcttgaatacactcattgattccacacagtgggtaataaacttttttttttttttttttttttgagacagagtctcgctctgtcacccaggctggagtgcagtggtgtgatctcggctcactgcaacctccgcctgctaggttcaagtgattctcctgcctcagggtccccagtagctgggactacaggtgtgcgccaccacgcctggctaaattttgtatttttagtagagacggggtttcaccatgttggttggccaggttggtctggaacttctgacctcaactgacctactcaccttggcctcccaaagtgctggggattacaggcattgagccactgtacccagctcataatgaacttttttaaaagagaaaaattttgttgaccattattggagctggatgcatctatatgattagatgtgcaaaaagctggaaaactcaaaaacaagtgatgattcatctttaggttttttttataaaaaagtagtggctgggcacagtggctcatgcctgtaatcccagcactttgggaggctgagcgaggcaggcgcatcatgaggtcaagagatcgagaccatcctggccaacatggtgaaacccatctctactaaaaatacaaaaaattgggtgggcttggtggcacacgcctgtggtcccagctactcaggaggctgaggcaggaggatggcgtgaacccgggaggtggagcttgcagtgagccgagattgcaccactgcactccagcctgggagacagagcgagactctgtctcaaaaaaaaaaaaatttaaaaactagcataaccagtgtttccttcaagtaattaattatatgggaaaccgagattcttgaattaagtttttctttactgccctatacacatttagctgttaaacttttatgattatctaagaagggctgaaacagttgaaattccaatttctttaggaatcaaaacattctcatgaagttgtgttgatttataacatgtaaatgcttgttctactgattgggcccggatcatgaaaggaatgaagtctttatcagaggcagttgtccttcattgtccatctccctgggaccatccctaataactagataggggtattttctctgttgacagtacagtcaaatcggctgctcatcaccattgtgggagggtctcaggctgggcaagggggtgtggtagaaaggtgatttatccatgcgccaggcccgggagtcagggactggaaccccagtctgtctcttgacttctttgaagccttcttgggggaatattactccccagtttttatatttatttattgaatggaaggaccagttagggcatgatctatcaatatccacatggctttaactttagccacttccgaattgctgttaaaaaaagttactgatcactacctggctttagagggcaagcagaaacatcccatggatgacacagaagtatgggtaggagaagatgccttcacctcttctatcaatcactgtgttccagtagatgatttcatactgacaacaacaaacagtcgctgtggaattttattaagccatcaaaatttccttcacattcaatactgttgaacaacaagataacacatcttcttgctcatcccacttgaactcaagtcatcaattttaggcacaaaggttttagttttctcgggaaatcaagttttaaccacttgaggttactactgcagcaagcagattttgttgacaaatgtgaacagctttcaccctctgttagtacaaattaatatcctttccttaaataaagttagttagctatttttggtttcaaaatcagtttccatcataaaataacagcaagacactgtacacctttacgttcaatactagaaatttcacccagtgcatcagcatctgtgcggcattccctcagcacgggctctgctggcgggcagcaggggtgctgagctctctctagtgcgccctgtgcagccacaccactgctgtcaccacatgtccctctgacggcagaggtggtataagcagcttcaccctggcccgactgaaggctgtcatagttgtttttcatattatgcacaataaactgtagcacaataatcatgatataacaactgtccagcaaaaataaaagtattttacatttgattatcatacaaaaatatgcatttttctatttttaaccattattaatagtacctaatatttttaaacttgtaaattaacaacaataaaatactacaagagttaaaataaacgtgaaggaagaaaattacagagggaaaaatgctcaatccaaaacatttagtaataataaaaaagcagctaaatgaaaaagggagaattgtgattacactgtcaatggcaggatacgctgtggtgttataaggagattgggtctggtttctaatcaaggactgtaaaatgtttaataattctatttgtataaactgaaactagcccttattttctaggcaacaagttggcaaaaaccttgggtttacccataaagtgaatttcttaagatattttttaagaactcctgtcctgttatatccagagacattatcaaattttaaaaggcaaataattcaaaaagaaacagctattcagtacatataaaggtaaaatacagttatcttgaaaacacttgttttagaaaaggaaataagctaactagacactttactataaaaattttccatatcttaggatggcagtttaagaaacagtcaaatttgaaagtatccatgttttaagcggggaatgaggagtgtgggggaggtggtgccccgtttcactgctgtaagaagcttcagctttgaccgctacagtggtaggtaggctcttgtcacacagtttggaaatactttactttagagagattcagatcaagcaaacaactgtgtctgctcattctcctcaactttgctgtccaaagttgggggctgggggagcacttctgtcgctattcaaatggcagtgttttgagagaatccatttttttatttctcctctattcctaagcattaggaactatgagagaaggacatctgtgcaggtgcccaactcgtaacctcattagttatttccagggggaagtgccagcaatagtttaccacactggaaatactgatggccaagcccagcacgcctcccagcaagccttgtttgtttttgagggcgagttttggcatagatggcactctcctgtctacagcatacacctctgtggaatcagcaccccagaggccactccccagtggctttcagaggaacaagactctggggactcctggctatgaagcttagtatgaaaagcctatttcaaatatgcaatgggattttcccaccccaattttaaaaagtgaaattatattttcttctgtaatatttgtatcctaaagtcaaaggcacttctaagtttaattatctgcagcaaatgctttaaaattaacagtgcatatcattttaaagttgaccctatgaagttaaaagcaaactcatgatttcaaaacacagtgatctaaggttccaaagaaggtgatctaaaatcataaattctggccccagaacactgaaccttcatcaggtgagttcaattagagacgacagaaagtaaccagaaaaatacatgaatacttcctaaaacctgctggaggttttatcagatgctcctaaaaatgacacgaaacacaaatttcctaactttcctgttgtctgctgcctggggctgctaatgtgactgactatcagatagccttcaggaggtggtaggaaaaatggatggagacaaaaatgtagcagacaacatgaacagtttgatcacggttacaagagccagacctgtaatgacagaaagaggacaggaacaaaatttacatctctcttaaaataagtgtgaaagaagcatgattcaacatgtttttaaatattagtgcaaattccaactattattcttacatataaagttattagagattcaaacgcctaggttagcaatgttaattcagaggaaaaaagttgacagcttccctcaaaatgttcagaaaacaccctattttagtcttcatttgctaatgtctcagtagacaaccatattttggccccacttaaaaatttgcttaatggtgttcctaaaatgcttcgtctgcacagattccctacaggagaaaatggaaatgaggaggagagaaactccggtgtccccgaggtgtcggtgtggtgagggccgctggcgttgaagtacatcctgctctggcccagctccccatagcaggcctccagggggccactgcgctgttgccgcagcatcctgctcagtacgtcgacttcatcagccaggagggagagcttgtgaaaggctgtgatggagccacccaggctgatctgggcctcgggaacccagcggaagtagcacagtttccacagttttatgtgtgttccagagacacgtggcagaataacaccgtgcaggttggcgggtttggaaaaccattctctaaaatactgctccgtatcactgttctggctgtcggtttgctgagctggatctggctttggttttaatatcaatgaatttctccttggaagtaattcttggtcactgatgattccattctttaaggcagacggcattcctcttagtgtggagctgtagcttttctatacagaagagattttattatgttccggggattccctttttagaaagattgaaggatgcaatggcaaatataaactcaatactatgaaaaattaatggaatttcagcctcaaagaacattttcctcccttcctttgtgtccttattctaatcctcctcccctggaattacacttttttatgtgttgactctacctaggctgttactatcagcctgaatgggggcgggatgagagtacctcctatccactaatttgcttaaggataagttctaagacgggctagaaaaaacactagacctggccgattctatcaagaacaatggcaaactgaacagaggcagtcaggaggccaaatgtctgattctttgttctgtacctttcagtagtctgcaaattttctaccaaaaaaaatcccaagaatttatttgggaattattaaaaaggcaaacaatgaatgttattaggacaagaatatagcagtcaggaggccatgactacatcacagccaggcggcattccctgccacagtggcggcttgaatcatcaagaaatggataaatggggctttagtaaatcaggcttgcaggctcaaagctgcaatctgcccactctcaggtactgagactttgtgggcctcagacaccaggaagaaagctgggatacagtcatttgagttaaaaagggaatgacccctcagaaacccgcattagcagtgttactcttggaagtgcctttacttttaacgctctctgttctgaaaaagaggtgtttggttacgtgtgagccaacatcacgttttgttagctgtgatttacctttgtccgtttaaaagacttcacggagccattctgtatacaaggtgtgctctttccaatgtagaaggggttatggaaaagggtgcgatcctttgctgtaaactggagagaccagtcccaaacagaggggaattttaagcccttctcatcacccaattggatgtttttgcttatagcaaattcctgcaaaataaataaataaatatttgcaaaact

SEQ ID NO: 48 - DNA, 52664 bp, Homo sapiens
agaaagggcctgggcggccgcactgagagctttacgcccggaggcgtcggcgctgccactggcccgcgacgggaacggggcgaaaaggcggcggcaccatgttctccctcaagccgcccaaacccaccttcaggtcctacctcctgccaccgccccaggtaaacaacccctccccgcgagcgcccgactctcctctgcgcttccgtggagcctccaggccgacccccgggaactggaggaccccaggaggctgcgcgcgtctccctgcccacagcagcgcggctgcctgattcccggcgccgcgaaatgcgccttctcgggagcccccactggctcggcgaaaacttgtaaaactcttctgcagccattctctgcccgaagttctgtcgtccgtagttttgcggagtgttgaggcccaggggagccttgggagctggggttttctttagtttccaacccatcgaccctccctcgtatgaccgccagcatgattgcagcgcttggggtcactggtcgaggcggttacccgtctgtcataaatgtgaacacctggaagcgacactggcagtttaaacattttttattattaggcttccaagtcgataatgagcagatcttaaaaacagctcagttaatatgcgaaagaatttaaatggggggctgtgtgtctttcgcatgtgtcatcacttagaaaacaacatttgctgtagcattttacggagggtggggggattgagattttgatttattttgctaatgtatttcagactgacgataagatcaattcggaaccgaagattaaaaaactggagccagtccttttgccaggtaaacattagttaggattctaacagatactttagcaacgtattttggtttaagattattctgccgactagtatcatgtggttaacttcccttctctcattaaactttctccagttaaaagtctagtgactgagaggagaaaaaggaactgtcaagaatgtcattacctcatttccttttttgtctcccgaatttctttttgaaaagatgtatatgtttaattgcttgggtagtaaaagtactctttgctgacgtgtttgccacttattgcattaatgattaatcattttaatgcattttgatagtataaaaagacgcctttattatgtgtgtgtctctataccaataacagagcttagtgaactttgaattacttgcttggcaattgttttttgaagttgtcagctgtatttgcaaatttgcttgtttcagtttagaaccaggcttttcccagcagagacacttaattgacatttggggccagataattcatagttggacgggcaggctgtcctgtgtatagcaacaaagatggcctccacccactagatgccagtagtagtacccttatcccccaccacctagttgcgacctagttgccacaccaaaatgccaccagtcattgccaatttttttttgtcccctacctctgggggacaaaaatctcacagttgagaatcactgctttagaacaaaatttgctataggtgaccttagagatggaagtagggattggtggtagaaaggggtttgttttagagcatacagaatattggtatggtattttgaattgtataacaattgtataataattaggaaaagtcagttgtttaatgcgattattaggggaagtagccagatacttaggaaagcctgttttaaacctgaaatcggccgggcacggtggctcatgcctgtaatcccagcactttgggaggccgaggcgggtggatcacgtggtcaagagaccgagaccatcctggctaacacggtgaaaccccatctctactaaaaatacaaaaaaaaattagccaggcatggtggcgggcgcctgtagtcccagctactcgggaggctgaggcaggagaatggcatgaactcgggaggcggagcttgcagtgagccgagatcctgccactgcagtccagcctgggcggcagagtgagacaccgtctcaaaaaaaaaaaaaacctgaaatcaaatactagtttgtgtggctactatcagcattgcaaaatctgactcattacttaaagccaaatcggtaaaataattagaattttgtaggtaaaaattgaacaaatgtggaaactttaaaattttaaatattatatagggacaaaatattaaaaacaccaaactttggttccatatgaaagtttaaaaagtgttttttaaactttactatgggagtcataaatattttcccttgattttgttagtgcttttcactcaacagtgtgtactaattaatcatttgtacttttcctcagagtgaacagtagaattactaagtaacccttgctccctgtgtgctctgttttagtcttagtcactctgagcatttaaaatgcagggacgaggaaacagtactcatcttgaatgagtgcctatgagctattgaactttgacttcgtttactctgaacaggcctggttcttaggctttgattcctccactctgcatactatgatttcacactcagaaacaacatggtcttagctgtaaatgtcagtgcttgctttttaattttttaaaattttttttaaatttttttttttttttttttgagacagagtctcactcttacttgggctggagtgcagtggcgtgatctcggctcactgcaacctctgcctcccaggttcaagcgattctcctgcctctgtctcccaagtagctgggattacaggagcccaccaccacacctggctaatttttcgtatttttagtagaaatggggtttctccatgttggccaggctggtcttgaactcctgccctcaggtgatccgcccgccttggcctcccaaagtgctgggattacaggcgtgagccactgcgcctggccacttttttaaaattagcttttaaatttaagatatgtgctaagaaaaggtgttactaagtatgcataaacttgaagaactttctcactgagggttatcaattctataaaatggctaaaagtcagagttttctggggaagttgtaaaccaagtttctgactgtgcttttcttgtcccagaaatggcagctaaattccgtattatttttagagaaattctaaaagagctgtaacactaagtctgaaccttttagttgcccattaaggaattctctgacctgtgttaatttttattgcattggcggccaaatcatagctgaaatctgtacatgcatacatgacggctctatcacccagcattctgtttgtacctgacttatccttacccaacatttagccggtcctgaattaggatgtcttttgcccccttcctctccccttctgttcttaccctctcattctggccttcctgcacccatcctggctgtgttctgtctggctgccctgttgtggtctctgtttcctgctttacctcgcctgtcacatctctcactgctaccatttgctctttgttggcctgtagcctactgctctacccatgaaatctggaagacaagtggaaagttaccgaactattggtgatctaaagacctagactaggctagagcttttactaagagggagtgaataatatagttcttgcctttgtgactatcagaatcaatagaaaacctggccacatcacctgtggctatatacagggatgcagaagttattgttcaacatggacaccgggaggggaacatcacacaccggggcctgtcgggggtgttgggggtgggggatgagggaagggagagcattaggacaaatacctaatgcgtgcggggcttgaaattcccggcgtcatccctagatgacggggttgatgggtgcagcaaaccagcatggcacgtatatacctatgtaacaaacctgcacattctgcacatgtatcccagaacttaaaaaaaaaaataaaaaaaaaaagaattaattgttagagatatggtattgcatgctttgctttggcataatgccttgggtccaagggtatcctacttcagttgcccaaagtttgaacttctaattcaataagcagatgaaaattagaacacaaaatgagttgtttatttgtgtgctgtcaccatgtgcactgttggaacttaagcctaatttcaaaatgatcctcatcttttattaagtaaagaaaacagaagaaaatgactagtaatttaatttagattgtggtttatgttagtaattttcagctttcctgatacatgaaactctgagatgggtattgtgcctacttcaactttgtggtcttgatgtctcacaaagtgccaggaatgtggtagacactgagatgtttactgagggactgaacgaaaggacctctcagaccacctggcttaaactgttaccttacccaggcacacacacagactaactttcagatttaggagtaaagggaagactgtgttattttatgccagacatttcaagagatttatgtcggagcctggaattgaaatagagtactctgtcaaagtagtcagcttttgtgtaggctttctctttatcttcctctcattatgtgaatttcattctttcagtgattatattgtatatgtgtaaaatcactccaatacttgaaaactgagtttgacttttaaagtgtgtgtgtgtatatatgtttgtgttccagtatatatttgttaagagcatgtaatgccagactctgtcctgtttagctgctggactggtggatcggttcggtgaggatgtgagtatctcctgggtgccaggtctgtcctggatagcgagaatgctggaggtgtcatgtgcctgtatcgcagaaaggcgtggggtgagccctaagctgcctgttgacaaggtagaagactgtgacctggatcactggtacccagattccagccagggcctggtatcagatttggatgaagtttttaccagcccttggtcaaagtgagaaaattaagaaaagtgcagttttctttaataaagataaatttatttgatttaaaagattgtcttttattctgagattatgttcttctaacttacttggaatagatactttttttgttaaatgttggtgataatagctgtagctttaaaaaagtttttaagttaacaaaattaaaaagttaaaaactctttattggtcctttaaattagttttgcactatacctggtttggaatctaaactagaacctactagatgagattattataatactatagatacaattttgtgagcactcacacagagaacattaattattttgtctgcctaggagtactgccatttttttgtttgtgttttgagacagggtctcgctctgtcacccagtttggactgtagtggtgtgatcacggcttactgcagcttcaacctcctgggctcgagtgatcctcacagctcagcctcccaagtagctaggactacagacgtgcgccaccacacctggctaatttttgtattttttgtggagatggggtccaactatattgcccaggctggtttcgaactcctgggctcaagcaattggctcaccttggcctcccaaagtgttgggattatagccgtgagccaccacacccagcccccttccaccatcctctgaaaaatgcatcctccctcttttgacaaattatcctttcctgactaactccacccaaccttgggttccagtgtggccagcaaggttaataacccaccctggactgcaagcatgaacacaggtctgcctctggatgttgttaggttggtactaagggaagaggtcctctttggtaatgctgcaagtggccacagttccagaagaatctgttgaaaagagtgaagaaccccaaggaagtgcactaatgtgtgttgaagtccctgggtttcattgtccttgcaggccaggtgacacaaaagccttgtattcttctttttgctaagctattaccaggcatgtttctgaacatactttgaacgaggatccttaactaatatagcttgcagattaatcatcataacagtcttgtcagctaggataccagtttatctccatttgacagatgtgaaaactatagtttgctgaggttaagtaacttgcccagtgtcacacagctagcaaggcagagccagagttctctgtccagctcccaggctgtgccactaactgctaagtagcacggcccacctggctgcactggtgacactagggtacagatttatgctttggaactgttggggagtagattggatgtcagcctagagggagttctctagtgaagtaaaaagagctctgtccttgtctttgcccttttcacaacagtgacagattttgacccagcgtgcagaagaactttcagagaatttcagctgccagaaaatggaatgtcttagggaggtagtggacttcctgttgctggctgtgccgaagcacagtctggtgaaatgccagcagctttgtattgaggatgtaagatttgcagtgagtggggcttgatggcctttgctctcttctcaccccagggcatgctcttttttaagggagaagagttgaaatgccaagactaacgataatgaatttgttctgcaggtattgagtgtgtgcttgatgcagtttggcagaagggtaaaatgctgaggagatgggatcctgttcttagacagtttcagttcactggagagatgcttcagtagaggagagaaaaagtagtaagagctcagaggaaggtcacctaagccagatttggagtagggcaggggtgtcaagaaagatctctggaaacaaatgcttgtgctctgaatcttgagtgcccgttgagcctgggcccctgtgctgaggctgtgcgtcagctcagttctttccctgttcgcatctacagtgctcacagcactttcattcttgagattaactattagataatgaatgcagtgattgtcagagtcttttgtaatcggatcagaaaagcatacaaccatgggccatctgggaaatgaaaatagccattgttgtatagatgtcttgtttattttttacaagctcactggcccgtactgttcttgttttctgtctcaccatacgtcttatttcctcagttgggttgttaattccttaaaggcaaagactttatctttcaagtgttttatgtaattcctttttgtaggtaggcttcataaatgattgtagactgatttttgtagtattttaatttgtgaatgcattgtttttgaaagaccaaaggacttgtaacacaccctcagaacagtgaacagtgtaactgtactatcttagcattagctttataccttacccgtagagccttaggaatgtttggagctgtccattccttaggcttttgctgcagtaccttaggccagcattttcttacccctccaaactcctcactatcgttgtcaacaccgttcatgaacctccataaataaaatcctacttaagcaggataaaatccaaattctttaaccttgtaatttgctaacactgtacctcactgacttcatttctcagtatttcccaatattgatatttgcttcaatcatgccgcttccttggtctcttccagatgccttattccttatttaggaccttgttactgttattatcacacattctctactatctcaatgctcttcttccttcaagatttcattctacaatttttcctgagatcggcactatacccttcctcctgccccatcctatcctgagtgctactcactggacttggtacttgcttttttacattgtgtgttagtaccagcattaaagatttgtgtttatcttccacatagtttcaatttcctgtgataacttttgagccactttaattcctgaatttacctaaagctagggtgaccagcttgtcccagtttgcttgagactgtcctggttttagtgctaaaaataccacatcccagggaaacccctctgtcccagacaaactggggcagtcaccctactgttaaaagcccaagttaagttatgcttttggcctctacacatcccacaggttaattagccacgtgtgccgtgagactttgccttaaactgtgttccaacctaaaatgtatgggaaacattatttctgtccatcaaacgtgatgaatttctaaatgtataaggtgttaggaaagataatacaacatggttttgaggtcctcagggagttaaaaactttcctagccatatcatttggaggtttattaactgtaattgcatttcccttcttatttatatttacagatgaaagggtcttgagaaaataaacttggatttcttgatttcctcccaggtgttagtagaaacctttggctcatcatcctctaatttagaaggtttttgcttaccgcacactgaagctaatttcctgctttttctggcttcatgaggcttccttgtggcatcctgggaagtgcttggtgctgtaaatggtcccaccgtggctgatggcatagcacagagctgggagagaggagtctggtgggttctcacaagcaggccagccagccgtctctagcacaccacccttttactgcataaaaagcacaggcgtatagtctccctgaaaacttcagaacctctagagctttgaagcttttattcggagttttctcttcaaggtcacttaatttaacatgtgaacaagagcagtctcagtaccttctttttatatatcctatctgggaagaggccactttgtgtcttctttttcttccctgtgtataagctagttttctggcccacagtgtttcagtgcatggcaggagcttatgacagctcctcttcagcattccttttttttaaaattatgaacaaatgacttacgtgagcagacagctgtgctacatgatccaaatattttaaagactggttctgcatgaacaaaatttagcattatcaaataaaactcatgtcactaactcgacacttaattattgtaataggaagacccaattgtagcatatcctcagaagtgcccttcttttctttcttcttcccctgtatccctctgtacttctgttctttgctctcttccaagggctcatttccattctgtaagaaaaggctgtgtggcgcttaaaagaccctggcccagagagtccttctttcactttttttttcttttttcttttttttggctgttgttaatgttgtgtctcttgtttattttcttctttagtagttttattttggaatgaatttgaatttgtaagagttgtacaaaagaggatagagttaatgtgaactcttcagccagcttccgctaatgttaatagcttatgtaaccttggtgaatttagctcaactgagaaaccaacaatactattagctaaactgcaggttttattcgtatttccctagtttttccacaaatgttctttacctgtttcaggttcacatccaggatactacatagcatttagttgtcgtgtctccttattctcaatgtctcagtctgtgacagctttttcatctcatctttcaagaccttgacgtgtttttttctattgaatttgattttcttttttttctttttcttttctttttttttttgagatggagtcttgttctgtcacccaggctggagtgcagtggcgtgatctccgctcaccgcaacctccagctcccgagtttgagcgattctcctgcctcagcctgttgagtagctgggagtacaggtgcgcaccaccaggcccagctaattttttgtgtttttagtagagacggggttttaccatgttggccaggctggtttcgaactcctgacctcaagtgatctgcctgcctcagcctcccaaagtgctaagattacaggcatgagaatgagatttttattttgcctcaaataatacatattaaagctctttaaacatagaaatatactactacaaaaggaaaaattttataattactagatttctgttctaacaaaccaccccctagaaacatcatcaaattgacttaaaaatgtagacgtaatttcagacttagagaaaagttgcaaataacagaagaatctgtggataccctttccttagattccccaataaaaccttgacgctttggaagattattattcaggtagtgtcttgtagtatgcctcttggtttggatttgtccgatgttttcttttgattaagcagaggttatggattttgggaaagacccacagaggtggtatcctttgcccttgtgtcatgtgagcaggcacaagacatcaacatgattggttattggtgaggttaacctcgatcacttcaggttaaagtgatatctgtcaggtttctcctctagaaagtgactgtttttccttttctgtactgtttgttagaaacaaatcactaagtgcagcccacattcaagggattgggaattaagctccacttcctggagagaggagaatcacgaatttatgggcataccttaaaactaccacagtaattagtcaatacttttgggaagatagctttgtgcttatacaaataacctgtttctccttaaagtttggctctctgaatttagcattcatcaatgcatgttgcacacagcagtcattcagtctatgacattgagtccatgatagtttcttgatctttactgtaatgttctaatcatgattttgtttccttattcctcctacatttattaattggaattcttctgtgaggaagatttgtctcttctccgccatttatttatttattattcagtcatctgttgacaacagtatggattcacagatactttttaatttactttctaatccggcatttttgttatttcttttgttgctcagattgttccagctttggccattgagagttatttcatcttggctcttgtatcctttggaaatgccgtccccccgcttttcttcacccccacttccatattttctggtattctggcattaccagaggctacagactcatcttctgtttcccctgccccagccttggaatcagccatttctctaaagagccctagttctttttattggaaaatggtattttaaaagcaagagctgggtactgagtgtgtatgttgttgctggagcgtcactgcttttagcactttcagagggcagagctagaaaacatacacacatgtaccaacccaggtgtacacacatctgttactgcatgtctatttgtatgtttattaaggcaagcataagttcattctgctatctcaaactcttaatctagcccctcggggttcatttccaaattcttgcttttgctttttgttgatggagtatgggcagtacagcagttaaacctggtttccatatttactttctgctgagtgctgtagctcattggtgagaaagggatcttttgacttgacttgcatggacacattctagtaggaaggttgtctgtcctcatcactcctgtgagtggtcctctagagctctttgaaatggctacaacattgcagatcaaaaacacctgcttttcaggtgcttcacttctcacctttcagatgggacatgcccagttgtgtcttctaaaccttgtttcagataattttaagagttgtcgcttcagtaactatctctaacacagggatcagcaaaccttttctgtgaagtgcagtaaatattttaggctttgcggaccataaggtatttgtttcaagtactcagctctgtctttgtcctgtgaaagcagccatagatggcacatgaacaaatgagtatggctatgtcttactaaaatttcatttacaaaaacaaggttttgtatttggcccgtgggccatggtttaccatccgttggacccattaagtatattctcctcctcttctttgtctcattctcactgcgttcataggcttgatacgttaacattcgtgcatcagtaaaagaatctggcttctagagaagaagggctgtccatgggcgtttgactcctaaatacagtttgtttatggtactagtgtggccacaaggctctgccacacaagctctgtctcttccttcctgttattacttctgcttcccttctcaggaacctgaaatcatatggtagtttgtttgtttaagtgatttttttttttgagatggagtctagctctgttgcccagtctggagtgcactgcaacctccacctcctgggttcaagcagttctcctgcctcagcctcccaagtagctggggctacaggtgcgcaccaccacgcctggcgcaccaccacgcctggctaaattttttttttttttaatagagatgggtttcaccatgttggctcaggtggtctcaaactgacttcaggtgatccacccgcctcagccaaagtgttgggattatagatgtgagccaccacgcccagcctttaagtgaatttttatttgagtataacatgcataacaagtttgtgtggatcataagtcttagaagtggatgaatttttgtagcaaggtttgaagagtctgtttttagatgagtttgctaaggtggcacagtatgtgatgattccgtgtaaagaagtcattgttacagggctgtgtcctctatctgaactggcatggttagtttagttgtttaaattgagggcctgcttacaattcatatctaagatttactggagaggagaaagggttgagtattcagtggcccagaatctgatatgggaattggtgaggtttatgttcaaggagccaaagaagatttaaattttatgtatttgaattactcagtgcgtctatatatatatatatttggtcatcttaaattttttttctcgttagaattcagttaaggccaatatttgaactttaataagttttggtacttgctacactgcagtacatttaattgtatgtaattatagggaaagactatgggaattgaagtcagaacacttggttataagtgcgaagtccactacttctttttaagatcttaggaaagtgatttaacctctttgggtgcaaatcctttatctgtgtattaaggaaaccatctgccttcctcaccttacaggttgttgaaagaatcagacaggacagatgtcctatttatagctctttaatgcatatgtaggcaagcagtggcagttctgtgactcttctctaacttacatatcatttacccaaacagcccttatcttccagccagcttggctgcttagccatattgaattactagtttctcttatctagaacaacttctgcccaactcatggtggacagaaccaagtgtcatgaagtgattttattcattcttgcattcagcactcttttcacaggcacctaccctgtgccagacactgttctaggcactaacatttcagcagtgaataaagtcagtccatcttctaccctcatggagcatataatcctgagggtaatgcaggcattaatttaaaaatatataaatataattgtagctatcatgagtgctggaaatacaatgcttcgatatgtgaatgtaaactagataggaagatttttttaaagaggcattccctagacagtggttggactaaggtagaagaaaagaatattccatgaaatgggaagaagcatggtcccatgagggattaataggccaccactgtgggcagagcagtgagggtgaggaaggctggtagctggctgggtatgcagggctcccagccatgagagggaggcttgtcttcaaagtggaagttaactcaagctgttggcactgtgaatttgacatgagcagattttaggtaaatgttaaggggcagttactaaaactagccttgtacatttttaagaacttcgaataaaagttattgcagctcaaatttgttataacctatttgttaaagagaggattgttttgagactatagttccattcttcatgaattggtaggagtttggagtttgtcagcaaacattctatcgggctaaaggtttttataatgaaagaaataggcaaagtggatcagtacactcacttttctaccattgaccctggagacagatggcttaaaatgttctgcgtctagttgacttttagatcttgaaattaaggtttaatgatgaccaagctttaaataaattgtagaaaagtattctttcaaaagtacattataacttttatattggtttcttatatttatttcttttaatcttttcttttaactcaaactacgttttaaggttttgttgcctactaagttataatctgagtgcagaaggaaacttgatttggctttatggaatacattttacattcagtgaagctgagctctgtttctcattccttacaaaaggaatcaaaggcattggtttgagagatcaagtcatgtgttaataaaacacaaatattccatcaagtaatactctgaaggagcaggtgtagtttatttcttctccagaaagtcttccagcagataaataatgagaggtagtatggcataggaaaaaagtacactgaagtcagcctttctggttcaaccagctcagacccctgagctatttttgcctcagttttacgccttggagaacaatgccttgtcattactattcactttatgaccatacagtgcctggcacctggtgggcaattggtgaatgttttcactatcctcatccttgccctcatgaaacactccttctaggtcccacaaagaccgttggtattttatgacaaagtaccttacaaatatttttctttttttaaaggagaaattgtcgtaaatgaagtcaattttgtgagaaaatgcattgcaacagacacaagccagtacgatttgtggggaaagctgatatgcagtaacttcaaaatctcctttattacagatgacccaatgccattacaggtgtgttttattagtacactgtttcattctatcaggctttcaactctaagtggtacatattattatataaaacataggtatggaaaagttatagtagaagtattaggtaatgcaatgtttgggataaattatattaagatttaaagtaaagtttaagaagaatgttggaacttgctagaggagtattagtgagaggattgtaagtcaccttgctttatttatcctctgtgatcgttcattatatgtccttttcattaaggaagttattccctctgttgcagatcttttaacctgcttataaaaatgacataaagagaaaaggttgtttgctaaatgattttataaatgccacacattttagtgatttcataggtttttttgttgttgggtttttgatttttttgttttgagcctggatctcgctctgtcttgtctcccaggctggagtgcagtggcatgatgtcggctcactgcaacctctgtctgcttcctgggctcaagctatcctgccacctcagcctcctgagtagctgggactacaggtgcatgccaccactcccggctaactgttgtatttttttgtagagatggggttttgttatgatgcccggattggtcttgaacttctgagcccaagcaatctgcctgcctccccctcccaaagtgccagagtacaggccactgcacccagctaccttttttttttttttttaaactaattagtgttattttcctaaaaagttaaattctaatttctaggaagagtgaagaatagtatcgatttaaaaattttcagtagccctcttgctattttatgttcttactggaaagtaatagttccatgtaattttggtttttagaagttcaggcattcatttgattaacttaaaaaccctggacttttctgtcagccattttgtattttgttttataaagtattatacacacttacccctagatctttctttatagtaattgttctttaatgaaatattggtatatgaactgtaaacttttaaatttaaggatctaatagtttagtgtaagtatatttcatgtagtcactcactaatttaccataattattatactgtacaaatatttattgtactgtatatttgtgtgttcattacagtcttatgtaggtatatttagactaaatttaaggcacttaaagatacccactgtgtagggacagtagcttatttggatataggcttgtgtgtttctctttgtttttagcttcataatgatcattggccccagacttcactgtaaatgagaagcagatacctggaacagcttaaatccagtaccactattaggaaaaagtaaaccagtgccctactgacagcagattgatagtgttaactacgtccttagtttgaacatgcaaaaccttttctaatggtttttatttctagtagactttgtgctttaaaaagatagttattttgcactttaaaatcttcagtgtgaaaatcaaacatgattttacccacttaaaatctgatgacctaagagcccttttttctttaatatgttgtggccagcttatccagatctagacatgcaaatgcttgctggtaaggtgattgatgatattccctatcttaggtattataataagattgttgtgtacattttaacctaatttctatctgtcaacattggaatggccctagctacctagacaaaagctttttgtgctttttagagataactgtcacagtttatcatcacagtttaaggcttatactaccattgtgagattattgggaaaagaattaatatgaacataattttttattccagaaattccattacagaaaccttcttcttggtgaacacgatgtccctttaacatgtattgagcaaattgtcacaggtacgtagtattccgtacatactctaaaagtcaattccactctggaagtattatttgaaaagtcatacctctcaaaatacttggattggcgttttatttctgtaagtttacttttgccgtttttttgagtcccgggaacataaagagggatatgttaataaattattttaaaaggaagatataaaatgtataacttttcatagtttctaggttttttgtcctctttttaattaaaattaatcattaaatgtgtctagatggtggttttatgcaaataatcatttaaaatatcttccaaagcaaagttaaaaccaacccccaagttctaggaattacaagtatgaaacattctagacaagcagagctcaaatgttgggtgaccttccaattattttcactaagaatttgtattaaagggtgagtaacaaataactgttacgcattttattttctctatttttttttcttttttagtaaacgaccacaagaggaagcagaaagtcctaggccccaaccagaaactgaaatttaatccaacagagttaattatttattgtaaagatttcagaattgtcagatttcgctttgatgaatcaggtcccgaaagtgctaaaaaggtaatactgttaaggtttatcaagttctgggttctgtactgtgtttactgatttcaattccgtatggcagttttcatttctcaattgctcagatgttttttaggggaagttatcagacatcttcttaagtaaagtcaaagccaagaatattaatagaactattttcttggattggtttatggctgttttaaagtgttctatataactttttatcagcttctcaaatattaaagactcttacgtggaaattagcatttttttacataaagatcattacttgtcagtttcttggttaaaaggttgaaaagttggtgatatactgtaattaaggtttggttaggcttttaattcagtactgcagaactttaccaacaaactgtaagctagacttatgttacataagatttaggtaaatatataattacgggaaaggcctagtaattattagtggtttaaagaaatattatgaattgagtgacactcaacaggggcaacacaaagctagtaactttttaactgccttatttttccacggccttccagataatgacttattaccctacttgtaagagtcaagggcatgttttccatgttttgctttgccagaggagtgaagctggtagacctaatatggcccccgttccagtctgtgctgcagcaaatgcagagtcacagactttccagtaggaagcttgcgcgtgtgtatgggaatagggcaacagtatcttagtataataggacgtggctttctctcagaatggaggcagtctttgcaccaccaagcaatgagtgcctttgttttccatggttagtcaactgactgcagtaaatcttctgttgataccaaaacaaggctggcaaaaatactgtaaggcagctgtcttcatatactttggtgaagaggtggtagatttgtttttagattgagaaccaacagtttcttcacaggaaggcaagcaggagatgaatatatgaaaatacatctgaaaatatgtgactgtctagcagagtagagtggttgtaggctcctctatgggtaaaagttttcaaatggtctgtataaccatctctcagcaagctgcattattgaaaattcaactagataactcttaaagcctctttcacctgttcgattgtgctgtttgtgattttggcattttactaatttaaagtgcctattatatagaaggactttagaattcatgatgtattagactgtacataaaatatttcagacaggttaattcctcaagcttatttatatttgtaatttaattgatcaaagcatcaaagacctgcttatgaaaaccttaagatgtgtagcatctcaagattagggacatcacagaacttgctagattgagttaggacagcatattcctaaggaagaaattgatgcaattgaccggatctctttcggaaagttcaattctccctcttttactgtatttttcagtttacactattttaatgagtggaaataataattatttggcctagttcttgaaccatctgtagtacttgttggtcatttttcatgttgaggcagtgtgctaaattttgcaagtagaaagaagggtaagatgcagtttcttgccctagagaacttaaatctagtgaagaagataaagcatgaacaaatgaaaagtaatggtacaaagtggcagcataaaatcaactacacaaatagttgatttccagatgaacagagcataataagtgctgtggaaattcagaatatcccctatgtgttgtgctgctggttcatgaagagggccttactaaaccgtctgcacaaaacaagccagtccctcatatgccctttcctaagaccaagtttcagacaaaaatcttttccccagtatcctaaaatataaaaagcatgtgagtctctgtcttttgtatagccacgggggttgcagggcaggggagggtgcaggaaaaaaaaatagatgcaatgagaatataaatagtttttttgggatttacgcatttcaaacagggttaagttgtatatggctaccaaagcttgacggctttgtgagttaaaaacaaaaattatggcatattcttttatttcaagtgaaaagttttcatctaaaattcggtagcagttaggaaattatggctcatttttacctcctggaagcttggaatactgttttctctggaaaatgctttgctattttatcagttgctttaaaatgatgaaatgcatgtttggagttctctggtgggtaaaccgttgattcattttgaaatacctaagccatttatgtttttgttttgaaaaatgaaattcaagaatactaaattggttcacattttgttaaatgttctgaacccttctggttgtcttgttggtgttgtttcaattgtattatgacaaaattagattgctttgggcacttgtactcattaatattcatcctcattatcctcgagctgtcacaggaaaatagtgatatttgggaaaggtctgtataaagaaagaaggaatttgatggtgcagaattggacatctaacctcatagcaacttagaaccaccattttcttttgcagaacctttgctcaaaactgaagggcaaaataataaaggttgtttttaatgatttatctatatatctgtctgtgtagataaagataaatatatagatacacatgagtgacaagtgaaatacatgccttttgtctccactttgttctctgattagtgggttgtgaatcacttcttcaggaatactttatagaagtgaattccattcatctgattaaggaacaagttggccttttcatgaactgtcatttttgacttgaatctggtactgttttttggtggctttcaggccacagaaataaaccacttttgtttgcaaatgagatagaacttaatgaggtttgagtgtttcctggatttgagtttcttcagtactgcaccccaggtgatcttaggaaagaaaccatccactgtgggtacttctggcttctgtccagagaagattatcagctttggtccaaaaattgatttaaaagtagtttacttctttttctccaataaaatatttgccataatttaatgtctttaataccaacattttcttcatttcctgtggtagccaggacaaatgaagtatttcagatctttcaaaaactcttaggatgaaaggtaggaatttggacttaggtttttaaaatagtgtgtatgtaaaagtgcaaagaatggggccctggctttctcttctcggagtgttccacagtaacaacatgaagacaatccaggtacacaagtttgtatgtgccttagtctgtgtgtccaaagaggcctcttacttaggtcatatgaacataagttatacacttgaaattcactactgaaaaacaatgtatttagttcgagttctgccaccccaaaaaaatcaacgagtaattcaactgacttgcagttttacaatatttttatagacttctttcagcgtagatgcttttggacatactcatttgtttcctaacctgatgtgatattgtgctatttttaaggggcttttaaaaaatacgctgtgttgggttttgccttgaaaataggctttatttcttttttgcctcatggccacaaaaaaaggatgtccatgatcaatgatctgtgaatttcttttctgtaaacagaaagagcatgtaactgctttctaattgttttggagaatgtgatagacattagtattattattattggcttggagcattttccttaatatgttggtaactacttttgtcagtgaatattagtgtagccactgttggacacagagcaccgtcagaaagctactgaagtggtgctgcaaagtgcagacatcttcagatctttactcaagtctgtgcagagaggtctttcttggtctccttctctactttttagcctgtctccctcttctcactgtaacacttcatattccccttccctgctctattatttttctcttttagcattcatagttatctaactttctgtattttttctctttatcttgtttagtgtctgtcttcccactagaatgtaagcttcatgaggacagggattagtgtctgttttgttcactgcatctctagggcttacaacattgtaggtactcagtaaatatttgttaaatcaatgtgaaatgtgtcatttatccttaaggaattgaccttcatggtagaagtgtaacagaaccacctatatcctacttttcatccacatcataactattatgtgaataccttggaagtaaagcaaaataagcacttaactaaagagacgctttatattgaaactgttgttctgggtttctggaattagtactctgaaattggctccctctaggaaggcttgtgaagagagtagtgttgaacagacatgacagtttccaagaaagcatagttggctaagaggagtaggattttccaagcaaagagtgtgacagtggagatggctggggctaagtcaggcagaatgtgttcaaacctgtttttctctgacctgagattgcggagggaatattgggaaggtatagttacctggtgaggagagccagttttgtgaagaatcaagaatgaggagatttaatttgttatgcagatgtctgggaaccacagcagattatcaggagagcaaaattgttagtcagaattacatcgttagaaggtaatccttaagttttgtagatttctagaatgtaaggaagctctcagaggtgccataaggtgagtatggcctaaggatgtggctatggcagtgtagcaaaatggacaactatgaaaaatgtctagagaaaagtgcaacatagcttatcaacggtgcccaaacaaataggaaggatgagaactttttcaagctacagatttcagtagttttgctgctagaaatgctttaaggaaaactgttaaaaagattaggaatgggaatatagataaccggctcctaaattttgcaagtgggaccgtcatagaaagctctcctataggtattgagaaatcgagataccacgtaagtttcaagaagcagttttttttttctttttggtcaaaactaatgacaaattctgtccccttgtttgtatattttaacttagtgagacaggaaacatttattctatagaagacttttaaaatgtagtttaaacaagttgacacatgcttactggttaatgaaatgtgcatcaacccactccaaacaccactaatttgacatgaactaacaattaacttttcttactcactgtcaaaagtatatcattctgccttaacttaacgctttaccttctaaataaaatttaatcttttaaataagtttttctgctatgttttccttgcatatgtcttaaatttcttctttcgtctttgctcactgaagagcattttctcccacattctagtgactaccagggtttgtaagcctagagcaccatccttcattctatctagcagcagttgagaataataacagccatatttctatatatggagctcctccaaaggcctagcctgcattaagcttgttaattcttaccacagcctaggtattacttttgttttacaagtgagcaaactgaggctagaaaagaggaaatgacttcacacatgttatgtagcaagtacttgacagagctaggattcaagccccctgatctgtttgattctaaagcccgcacgttttccaccacagggcacacagtcccaaaccattttacttaaacacagtttgtgtgtgtgtgtgtgtgtgtgtgtgtgtgtgtgtgtgtgtgttgtttttttgatgtacctctttgagccacccatgcatttttggagtttcttgctaattttaattttttgtaattatgtttctctatttagatgtttaaatccatgaggcgtaaactttaaagtttcatgccttatattaatcctttatagtccaccaaaaatgaaacttttttcttccttttttggagtggacatgtagtcactgcctttttggagaatgcttctttagtttgaagctttctttattggactaaaattactttccaattaaaatttaactcagcaaatatttactgaatacttgccatgtgctagctaaagataaacaatgtcttgagggcatgaaagtgaatgagatacctggccttaaggagctcttttatattctaggtcaacagaaaaacatgtaaatagtatctataatcactgccccaagatgatgctcccagtgcccaaggccttattgtacatttcatttaactaagtgtgttaaaatcaaattctaaatgtagaatttttcctaggtatgccttgcaatagctcattattcccagccaacagacctccagctactctttgcatttgaatatgttgggaaaaaataccacaattcaggtaaatatgaaaatattaaatattgtgactaattttacatgtgtaaattttactcttatgtttaccggaagcctccaagtacatgagctttaatgattgtagaattactagcttcataccttagagaagtaagcactacatgctaaaagagccaatagtttgtcagattatttcttgacaagttaccaggaagaacctttaatgctatgaatatgggcttataagttatgtcagatatttaatctccagtcactggcttgtattttatgatgaagaatatataacccaccctttttaattgatagcttgagttaaagtaatcttatcttttaagaaaactggcagaaaactaaaagatatattaaaagcataatcttttctggcaaggtgtgatttcatgcaaaagctaaagtgattaaaaactttttgtggacttcattaagattctcagaatactgagtttctatttctgagtaatactgatgaaaggaagatgagcatttttccaaggacaagtatattctagacagcttttgtgaaagtaaatagttttgtctatatatctgacagtcatgacatgaccagggaagattccagatgatcatgcaattctgtacattctgtttcgtacaaatgtaattttaataaacaatttttaaaaatatcttgatagagaaaaacaaagagccgtgtctcctgttagccccattgtcagttagtgactgcaagtcagttaactgagcgaagcctgtgttcttttatttaagcaagaaaaataaatcagctgtgtatttataatgaaaaatccattcacccagcatgctctgggccatacaaattattaattgtactgaaattttatattttgttaccacgaaacatggtagtaatttaaataactggcataataaaagtatattccagcaacactatattgtaaatacattaaaatgtatcagtgtacggtatctgaagatgcatgtgtataagtaaattttccttagtttaaaagataactacctttctgttaagcactgagaggaccaaaaaaaaaaaaaaaagaaaatacagtagagataatatatgaaaataatgctttgcagagcagcttttatcatacagtattatatttatagaaattgtataacaaaagtatttgtaacttaatttttcttatcgatatatacataattgtaactgaggcttaagcaatacagttattttttgaagtttattaatattaagtaaattcacttactgtctaaaaataaagtatacagatcctgcactattaggtaaacactccttgggatcatcgtcaagctacagaacagtgatcaaggttatcttcaataagatcctcacccagagttgcaagggttgtaggagtgagtctttgattcctgctcaactgtttatgatacagaccagttcttcatgctgctgtttttccaatagaaatgattcatttcagtttacagatccataacttctacagtaatgtagtgacttgggctcagcaaagacagtaaacttcattatacagttggtaacctgatgcctgcttcagttactttccacatttttcttcattcataccttgtgggcatctctggtttacagtactttagtttatccacccataggtcttctactactggaattttaaaatctacatcattcagttccactatttcttcttatatagcttattgataaaatttgatgattaatactgaaaatattcagggatgcttttttatattacatccttcagactcctcctttgacaagtacctcataaacataacactggccatagttttgttaagattcctcgtagggtaacatcctttaatatccttccatgctgttacagaagcataaatactgcatctttaagatcaaaaggagcctgaaatttccacacactgcagtcagaattcattaatttgtgagtgaaagatgcccactcatccactcttgaacttctggatgacaccttgattcattggctggattaaagaagtcctttttgcaggcaggtaggtgacaaagctgtttccacaaataagatccaaagttggaggagctcccctgcagttatctgagaaaatgatattttagctggccttagtcactcaggttttcattcatattcagtatcacatgaggaaaagccatctctgaaaggtcctgcagtcatcccaacacttctgtgaatatcctggagtaaagtaagatgtgtagcacccaggctttggaacatcgctttgcacaaacaccccaggagatattactagcacaaacaagaacaatgattctgttttttctcttttaactttaaagaaaccatgaggactctgttttcatcagtcagattattattgggcaaataacgtcaaaaaagtacagattcatctttcttatagaattgataagatgtcagattatgcttctggaccaaaaatattgaaagtttcatgaagttatctgcagcctagtgtcagcaactgcttcatgacagacatcctgcttacagatgctgtgatgtaatctgaagttgtaatgaaatttcacatcagaagttgtacattttcagtgacatttaattttatcctttttattaacatagatcttgttattagattttccttaaaatgcctatttgaaaaacacaaggtacacaatccatttgaaacagtataggaatttttaaactttgttgcttaagattctcagaatagctataaatgattgttgaatattggtggttccagccagctgtatacatcaggattactggaggaacctttagaaatgcagccatgttggctccagcacaggtcagaatctcccagttaagaaccactttgttgactcatgcttttgaactgattaatactcacagtcctctttttaccttattcctttgtgacttctaatttctgcagtatcatcagagtggtgggctttcttttcatatattgatgacttgtattttctgttgcttgaagccattctagatatcaattggccaattcagtggaaattatctaaaataaccccaacagtataggattagacttttgtactgtcacagaagatagccaaggtcaggagcatataatatctatttcacgcttagtctgctgtggaggcatgtcataaaacctcagtcaggtagcggtcagcggagccaggtctccctgagatgacccacctttcactgtgttggtccagcccctcatagcgatccactcatagagcaggccactggtatcaggtcttttgaactttggaaagcattcaaatttctggactataaaaccagattgagtatacattacacattctgtaatgagctctaactgaagatgatatagaacatataaaagacctagtcccagttgtttagaaaagtacaggatttgaacgagagaaatggcaaaaataacaaacgatagaggatctcactttatgcttagaaaatatagatgttctcattttacgtttagaaaaatttgtgtaagttagatcttgaaacaaaatttggccagagaaacaatctcataaacaatagcacattcttagcctagcttattaaagtctgcaacccaaaacactaaaaagtattcagtgctgctggactcagtcaccaaactgttttacataactgttaaaattttgagtgtgttttttataattcttttttggtggtggtggttttattgtttggctaggactgctggttcagtgttgaatagcagtaatattagcaggcataatttcacttcccgcttttaatgaagatgctcttagctatgtctttttgataaacaccctctatccagttaaggaaattcccttttattccaaacttgctaacgttgttgggtttttttttttaagtcataaacaggtatctatcatatgtttttctgcacttacagagctagtcattcatatagcctttttcgtgtttaatgtagtcatatgatgaattacttagattttctaatattgaatagctttctttgttttggtgcactggaacactgtatagattgggctttgccaaaaattccatatgcaggttttgtgttctggagagatcataactcctaagtcttccttctcacagacacgctttttagttgtgttactccagagaaggccctgagatggagtgggactctaggatgtgggcttagaatgagcattttactatctatctatctatctatctgtctgtctatctatctatctgtctatttatttttgagacagagtctcgctgtgtcgctcaggctggagtgcactggtacgatctcggctcactgcaagctctgcctgccaggttcacaccatctcctgcctcaccctcccaagtagctgggactacaggcacgtgccgccacacccggcttatttttttttttttagtatttttaatagagacagggtttcaccgtgttagccaagatggtctcgatctcctgaccttgtgatccgcccacctcggcctcccaaagtgttgggattacaggcatgagccaccgcgcccagcaacattttactttttaatgagctttgttaaaatcagaatcactggataattctgataccacttaagaggagtccaaattcctaacatagcccctccgtaatctagagcagcaccgtccagtgatggaagtagggcagccactagagccactagccacatgtggctgttaagtacttgaaatgtggctagtgcaactgatggactgaatttttaattttatttaattttcatttcagtttaaatttaaatgggcttgtgtggctagaagttacgtttttgggaaacatactagagtctaggccctatttgatttcccgcctctcttccaccacctgttgaatccctatgctctagctgtatttagttacttgatattatacagttataccatctttttaaagttcttctctgtctagcatgcctacctcctcctcaccagctacctggcaacttttgacttgttccttagaactctctttagttgtggtcaagtcatgaagcttttcctgccccggcctctctctgcagcgagagttaggggacttctcttttgcatcttcattgcactcagacatctggtactctgtgattatcacacttattaatgctctcaagatagagataaaatcttattcatctttttgctctcaggcattagcacatggggagttctcagaaaatacctgtcttataccaggaattaatgaataatcagtaggaatgagcatgacatgttcatgggacgttggagggtagtgcatggctgcagaggagaatgggaaatgaaggtcagataagttacgtgagggatctctaaggccaagagaagccatttaggtttgatttggttggaaaatgagcttattgaaagtttaaggcaagggactagcatcatgaacacatctttttagggaagtgtgtcttgtggtaagctgctggctggtttaaatgcagcagaatattccattggggatgccagctgggagacttgccacagttgcagcctgcagcagaaagaccctgggccagaatgggttgtgccatctgtcaccagatattgccaaggtagatctggctgactttgtgggacagcttgtttctcaataatcactttgcaggcactcttgaggctgtgagcatgctcccagaagatagcattacttctctctcagagcaggctcctttctaaggaaatgcaagtctaggcctgccctgctgtaatcttcatgtggaaacagcactctagcaaagaacaaggaacctgatgagcttttcaaaggaaaatcgagtagatacaggaaaccaagaattttctaatgagcagatagaaaagagcaggtaggtgagaagttggtattagaaaaattaaagatttgaagggcttgaggacagagatgattgttggatgtttcatttttccaggcaaaatatgtggagcaaataatcaaatgacatggacttaccccacaattagggacggagatgaggaagggttaggaatagtttctgttagaatggtagggatggaagacaattgaaaattaaagagaaaataaatggagaggaaatctaggcagcagccattcttcattctgggggaaggtggtcaggaaaaggaaggaagaaaaatgtatagcatagtagctagagtggtccggcgtgatcaaagtgttttcaatatcatgttgactgacctgtttacgtttgaaggcagagaagatagagccagtagaaggagagaaaaatcaaagctgttttacggagttgtgaaagagctggataaggacaagactaaatgagttatttttaggccaggcgtggtggctcatgcctgtaatcccagcactttgggaggccaaggcaggtggggcacctgaggtcaggagttcaagagcagcctagccaacatggtgaaaccctgtctctattaaaaatacaaaaattagctggacatggtgcatggtggcaggtgcctgtaatcccagctactcaagaggctgaggcaggagaatagcttgaacccggggggcggaggttgcagtcagccgagatcatgccagtgcattccagcctgggcgacagaacgagactccgtcaaaaaaaaaaaaaggagttatttttaaatggaaagggcaagacagttctcggagagacttggaaggtgaagcaggttagagacagcacatcagagtatgcatgtgacaggaggctcagagaagagggaatgctggggaaaatgtgactgttaaaattcataatgttgctttttcctacagcaaacaaaattaatggaattccctcaggagatggaggaggaggaggaggaggaggtaatggagctggtggtggcagcagccagaaaactccactctttgaaacttactcggattgggacagagaaatcaagaggacaggtgcttccgggtggagagtttgttctattaacgagggttacatgatatccacttggtaagtacaattttagcaatgttatatatggctggaagtcacttccctatgaataatcatcaaactctgttgtcattgatgactttcaagttgtggttaatggaatatttgtttttaataatgttttaataaatattttattttaaagatcaaggcttattaatataaattacggtatcccttaaaagaagttgatagtaattccttactgtcatcagtagtcagtgtttattgcattatatcttgtaactggtgttttacagttggtttgttcatatcaggatctaaagtcttcacattgaatttgcttaatatgtctcttaggccttttaatctacaacagtctcctcccacctcttttttacctactatttgttgacaaaccaggtcatttgttccctagaattttccacattgtagatattgcttgttttatccccagggtgtcccgtaatgtgttcctctgtctctaatatttcctttaaaatgttagcaacagaggcttaatcggattcaggttcagtacttttggcaagaatgtttcattaggtggttctgtgttctcctgtggagtcacatcccatctcaggctggctgggctgtgtctctctcattgtaatcctgacgaccagtgggcttagagggtgtcaacctgatccacccagtaaaagttcccctcttatatcatggtttgagctcccaaaaatagttttgcactgggagggaggatcattgctcagatcgttatttcactaaggattgctattgttcaccttctaattctatcatctttctgcttttatcgaacttttctctcaccagctctttagtgccctgtaacacagttcgtacaagaaaagcaatataaatatctacattttctcctttacttaacatttttccaaatagtgagctggttccctaggggatcttctagaagtgactaggaatttgtttttttaatttgtttaatgtcatttagttattatgaattttttggaatgccttattttaaggtcattgaagtcctcattagttcacgcacataagcagctttttagaaaaaggaagaaaagcactactgtgttattactggttaatccagtaccaggaacttctagtacagttctagaaaggtgctttgcagcatgtagcttgtatcttttgcttcccctggaatttaagcttcaaggccagcacactctggtatatgtgctgagaaacatgtgatggggctgcccagccacgtcggggaaagaaggaagatgtcttgaggtgcagtgagcttgcccactagtaattattgtctgatcagtgtcctagagtctgactgtgccttttaggcatggggaaaggtagaagagggacttaagaagagagctaaagctcctggtagatttgtggggttttcttttgtttgcctggtgtccttaaccatagcctgtcaagagaacaaaggtggatatatttttcagtgaacacatacatgtttaatagtcattctggaaaatatttctaataccttctttggaattttctcatgctataaatttagatttttaagaattggtcatatcgcaccaattttagactaagaggtgtaggatcgtcactgcccccccatggtgcccaccatgtggctactaagtggggtgcacattaaatgcggacaacttgcttaattatttatagggtctgcaggagcacactattcctgcttttagcacagcactcatataattttttttttcccctccagccttccagaatacattgtagtgccaagttctttagcagaccaagatctaaagatcttttcccattcttttgttgggagaaggatgccagtaagtgatttctgttggattttatgaatgctgacgtccattgtttctacacagtgaagtaaggattctacctctcccctagctctggtgctggagccactctaacggcagtgctcttgtgcgaatggccctcatcaaagacgtgctgcagcagaggaagattgaccagaggtaattgagaaatggtcattgtcactttagatagttttacttgttgtgtaactacagtgagttccctactaattgaaaataacaaaatgcatagtcttactaattagttagcaccatgttttatataagaattgccattttgaaaagaatgtgataatattaaaattaactgacattggagttacactaaatataatttaattatttggtttgtaagacacttgtggatcttacattgctgacatcttgctatagcatttcctataacatactttcaaagtgcagtgatatccagttgagacacttcaggataaatcaaacttttcttgtagtttgatgtgtcttatttaggtctacacatttgcaatagctagaacagtggttttaattagccaccacagacgagtctggcatcatctgctgtggtcattagtaacctccacgtcattaaagtaggaggcctttctcagttgtgctcatagcagtgagcaatactattgatcactctctccttaaacccgcctgggccctcagcctctgctcctctccactctcctgaagctcctcttcctcactggcactccgtgccttctgcagacccatcctcttctctccagacattacacagattctaaggccgcttcctcatgttctgtattcttttcctaaagaagtttccccaagaatgtggctttagtgaccaacacatttatatcttcagtctaccttgacttctacatggaggtctcaaagaccccttaaactcattatgtccaaaaccaaactcaaggatatggcctccatgccctcccccagcctgctctcagaaaccggggggtcatcctggatgccttcctctttctttcccttccccatcaccaatccctcctcaggttttctcacttcacttttcagacaccttgcaaacccatgtgcttccacaaacccagctccacctctgcctgtgtgttataagtgctatcatttcctccttccatgtctcctccacccctgggctccagccccctggactttccctggtgttttcaacctcctgacattgtccagcgctcttcccttctggactgccttctttgcactcatctgggaacactctccacgcttacccacttggcactccttgtttctttttttttgagacagagtctcactctgtcacccatgctggagtgcagtggtacgatctcggctcccgggttcaagtgattatcatgcctcagcctcctgagtagctgggattacaggcacccaccaccacatccagctgatttttgtatttttaatagagacaagatttcaccatgtcggccaggctggtctcgaactcctgacctcaggtgatccacccgcctcggcctaccgaagtgctgggattacaggcgtgagccactgcacccggctcactcattctttatatctcaattcaaacatcatttcctcaagataagccttctctcccctctaaagtttgatcagacctcaaaagtctatgttcttagagctcctgagtttttaacatttatttcagtttttaattatatatgtgtgtgttacagtttgattaccgcctgtcgtttttactccatgagatgagggactatgtctgttttgcacaccgttatatatttagcacccaggaagcatatatgatatttattcaatacttgttgaataaatgaggagtaaatgaacagatcttataaaacaggcttatggagcctcagaaattgtgtatcacagtcctttttggtacagccagagtgtagggtttttccactgtaccgtaactgacagagccatattcactgaagcaaataaccatcaagtgaccctcaaatgaccttcagttttctggaaaggaaggtgactatagttcacacgagtccgtattctctgtggattttgatttacctgaactccatttggaattaactgtctgctgtgtcatactccaagccttgttttcattagcatacatgctgatgaagtgcacagttaggaattttgctgttaaagggacaattgtagcattgttgggtgagagttagttataaaaccttataatcagtggcagtttcagtgatttattaagctgaaaattactttaatgccttttgtgttttcagctatcctattcttcataagtagaacagatcctcttttttgtccaacctcgtctcctaacctttttccctcaggtgtgtcatctagccccactggccttctttaggtttctcagcagccatgcttgttacctgccacagggcccttgcactagctgccctctgcctagaacattttcaccccagatctttacattgcttctctattcatttaggtttcggcttcagtaccatcttcacagagcagctgtttttcaccatgtgacctaaagtagcctgtaatctcatgattacatcatccatggcattcaccacagcccatttatcttatcatctaccccaccccacgaagaatgtcaaccccccacttgcttgggcaacaccagtagtaaaattggaatgatacagggaaggttagcatagcccttgcacaaagatgacatgcaggttcatgacacattacatattttaatgaaatgggagcatattcttgttatttaatttttaaaaatcagtttatcaagcaaatgtacagcgccattttatttttcatgcctacattaaattccatacacataaaggtgcatagaggaaacctagaaagattgcaccaaaattttagaattctgagtgattttgtttttcttatcttttctaggtgtttttaaacattccacactaatttatattactttttctattcaggaaaaaaaaaaacaacagcagggttttgttttgtttttttaaagtggtgtggaagttacccattgaatatagatgggaatcccagtcctggctgtttcctttgaaaagatctagagaccccatggcacatatttatagtagcccattctctcctaagaatagaggaagggtgggaggaattttggtgaatgtctgtacttgcagtttatcctacagcaaatcgttaagactgtgggaataggtgctttgcattctctagagctggagaatgtgcatctggtttgccatccttctgtctacatcatgtggaaagatgtgggagtgtagggtctccttaatctaaatgcagtgctgccccgccccccccttggcagtgtttctgtttcccaggcaagtgttccaatggatgtgctttattttctcccatcagaaataagggaatgagcccgggcgcggtggctcacgcctgtaatcccagcactttgggaggccaaggggggtgaatcacaaggtcaggagtttgagaccagcctggccaacatggtgaaaccccgcctctactaaaaatacagaaatttagccaggtgtggtggcgggtgcctgtaatcccaactactcgggagggtgaggcaggagaatcgcttgaacccgggagggggaggttgcagtgagccgagatggtgccactgcactccagcctgggcgacagtatgagactccgtctcaaaaagaaaaagaaggaaatgatctaatttgttctgtgcactgcacgtgggggtggcagtgaggtgaatggcagcattctgcagtagtcaaagccagatgggtgggagaagttgggtgctaagagggaaacaaagtttacctgtcttctccttgatttcactctcagttttatgagaatacagaaaaatcatgcagagaaacctgatggaatagtctctaaaactaaaaaataagataagcaatggttctgtcttaaaaaaaaaaaagtaaactccatgaaggcagagaccttacctgtctcattcctctctctatcccctggtctatagtaagggttaaataaatatatgctgaaatgaatgagtaatgactaaagtatttttgtctttattaggatttgtaatgcaataactaaaagtcacccacagagaagtgatgtttacaaatcagatttggataagaccttgcctaatattcaagaagtacaggcagcatttgtaaaactgaagcagctatgcgttaatggtaatttcattcttatttcatatatataatgaacacaggatacagagttgcatgagatgtcaggaaaagtgatgttcttaaaaatgtagaaatagatatatttaaggagtctatggaactatttgtacaaattatatattattgtatgagaacttcagaacctcctaaggaattaagtttaaactactttttgttttagagggggaaaaatgagtgtattaaatttccttcagatgatgaaaggtataggagaatacttttataaaagcatttgctgagtagaacactgtattaccttacagacaaacttattaagattgtaatacatacagttatactttgagataggtgacttgacatgggtatcaaacagctgtgttatatctgtagcatcagaattctgatatatctgagcaaacgtaccaggtggctttcatgtgtcctgcgggatgagtcacatgaaagcatctttggtgtaatgtgggtcctcctcaagagatcctctaagtcaccagggagtcagcaaaggcagccttgcagcagatcttgagcaatgagtaagcacttccctgggggagggccttgcaggggcggggcaggggcaagttgttgaaaaaactagtgtcctgaatgattatgtgcactctgggcagggcagtgaggatgcctgtcctcatgcagtggctagccctcggccacgtgagccatgcacagaggcaccactggcagcaggggtggggcagggaagcaggagggcaaggcttgcagtgagaaagccaagggctagggcctgggcagctgacctcacaggtcaggagggccaggatcaaggcataggctgagcagggacggctggaattcttagctgttgggagtcagagttggttggactccaagatttccctgaaagagcgagagagaagatgatggagccccaggggaatgctttgttttgctttgttacagaattgtaatgtcttcttaaatgcttattccatgttattaaagtgaaaatgcatgatatttacttaaagctaacttttaaatattagaaactgatgtatctctttactctgatagggatcgtataaaataaaaagtaaaaatgtgtatgtatataatttattacagagccttttgaagaaactgaagagaaatggttatcttcactggaaaatactcgatggttagaatatgtaaggtttgtacttctttactttcttttcctttaactttttattttgagataactacagactcactggaggtacaaaaatagcacagagggccatgtacttactcttcatccaacttcccccaatagtaacatctcgtaactagagtacagcatccaaaccaggaagctgacactgggacactggatagctcttactcaccagttcatacatgctgtcgtctgtgtgcatgcccttaacacagctgtgcgattttatcacgtgtgtaggttcacgtaaccaccaccacagggagatacagacctgttccatgacaaggctcccctgtgctagccttcttataggtgcaccctcatcgccatctgtgtctgttgactaccactaatctcttctcaatctctatagttttgtcataagtcaaccccttccttttcataaagggtttatgaatttccctgatgaaaaagtacaaaatgaggccaggcgtggtggctcatgcctgtaatcccagcactttgggaggccaaggcgggtggctcacctgaggtcaggagttcaagaccagcctggccaacatggtgaaaccttgtctctgctaaaaatacaaaaattagccaagcatggtggcacgcacctgtagtcccagctactcaggaggctgaggcaggagaatcacttgaacctgggaggcagaggttgcattgagtcaagatcacgccactgcactgcagcctgggtgatagagcaagtctccatctcaaaaaaaaaaatttacaaagtggggccggttgtggtagctcatgccagtaattccaaagctctggggaggaagatcacttgaggccagtagttcacaaccagcctgagcaacacagtgagaccccatctccacaaaaaagttggaaactagccaggcatggtggcatgtgcctgctgtcctagggagcctgaggcaggaggatcacttgaggccaggagttcacaaccagccgaggaacatagtgagatgcccatctccacaaaaaaattttaaaactaggcaggcatggtggctcgtgcctgtggtcctagctgctcaggaggtggaggcaggaggatcacttgaggccaggagttcagggttacaatgagctgtgatatgccactgcactctagtgtgggtgacaaaatgagagcctgtctcttaaaaagaaaacaaaaattacaaaatatactcctttgagaaatcgtataagtaactaaagaaactttacggtaatgcgaaagctatgtgcattcagtagaaagcagtcaatcctctcttgtgatgctgagtagcagcagggagccacagctgccagtcagccacacagtctcagtttagggtattttcagcttacagtgggttatcatgggtcatgagttatgggaatatcatgatcagagagcatctgtaaagtgagaaattagatttgcttgatttcaagtactttatgtatttgtagtggaaatttgatttttaacactgcttttccttttctctcttcagggcattccttaagcattcagcagaacttgtatacatgctagaaagcaaacatctctctgtagtcctacaaggtaactaaagtaactcctgaaagcaccatgaccaccataccagccagccttggtttactgcttgtccccattcaagtaaatcacatcagttttagctatttcttatttactacagtaccatcaaatacattacagattttgcacatcatttgagtaaaacagtggcacaggctgggcgcagtggctgaagcctgtaatcccagactttgggaggtcgaggcgggcggatcacttgaggtcagaagtttgagatcagcctggccaacgtggtgaaaccttgtctctactaaaaatacaaaaattagtcaggagtggtggtgtgcgcctgtagtctcagctactcgggaggccgaggcaggagtatcacttgaacctaggaggcggaggttgcagtgagcagagatcgcaccactgcactccagcctgggcaacacagcaagactcaaaaaaaaaataaataaaaaccagtggcacaaggactgcaaatagaagaatagaaagtagtccagtttttaccctttattaaattatccttcctattttatgggaagggtgggtcccatcccctaatggattaatacttagtgttaattttgacagggcattctctctctgtaattttgctgtctaatttgtacaaatttgttttagtttaaataccttctggctcatgctagattatgactctaaggaagcagtttgagatgaagaaatttagactgaactgctgaatagctagtaatgtaatatttggtaggaataaacggtgatgtaaaaatctttcagttaagcaaaggataattacatattaaataacttacagctaatagaatttgtaagtttgcagataaagttcaatagactaaaaactaccttcgtataatacagtagtaggtcctttgtacccatggcttccccatctgtggtcaaccaacccaggactgaaaatattggcgggggaaagctttggccgtaatgaacatgaacagactttttttttgttgtcattattctctaaacagtatagtataacaactgtttacatagcatttacattgtattaggtgttataagtaatctagaggtaacttaaagtgtacaggaggatgtgcataggttatatgcaaatattaacatcattttatatccaggacttaagcatttgtggatcttggtatccaaaggaggccctggaatgagttccccatggatactgagggaagactatatactcatgttgcatagtatatgaatacaaaatgttgcttaagcttgcagaagtactttttttttttttgagatggagtttcgctcctgtcacctaggctggagtgcagtggaacgatctcagctcactgcaacctccacctcctgggttcaagcgattctcctgcttcagcctcccaagtagctgggattacaagcatgcaccaccacgcccggctaatttttgtatttttactagagatggggtttcaccttgttggccaggctgctctcgaactcctgccctcaggtggtctgcccacctcagcctcccaaagtgctaggattataggcgtgagccaccgtgcctggccaggcttgcagaagtacatttaacaactgccaaacttgattgactttaacaaggcaaaaatctttaagactcttagaaaaaaatcaaatagtaatgtgtcatataaagtaatcctgaactgatacagtcagagtgtgtgtttaactcacaaatgcatgcagagcctaataatcacaatttctctcatccagtgggtgttctcatcgtattggagaaccctactcatcctccatttctccatgcatttgtaatagaaaaggcctcagaagtagcactgaaccttcattttactagcatttttatatacgtttatttttaaacagtttgttaaaaatttacatactatggaattcacccatttttaatttgtaattcagtaaattttagtaaatatacagagtctagttttggaaatttttcatcaccccaaaagtcccagctccaggcagccactaatctttctgtctctagattttccctttctgggcatttcatataaatggaatcatacaatatgtggccttttgccgctggcttctttcattcaacatacatgtttttgaggttcattcatgtagtgtgtatcagcaatcttttcctttttatttctgaattgtattccactgtttgtaaatgcattttgcttacccatttacctgttgatggacatttgggttgtttccactttgtggctgttatgaattatgctgcttcatttatttagatctttcattttatcagcagtgttttattatgtaagtcttatatttattttgttaaatctcttaagtattttatttttatgtcactgtgaatataattgttaatttcattttcaggtttactatgtactcagattgttgtgtacagaatttctgtaaccttactgacctcatttattaattctagtagttattttgtggattccgtaggagtttttacatacaggatcatattgtcttcaaagacagtttttacctttttctttctgatctgaatgccttttattttctttttcttgcctaattgctctggctagattctccagttcaatgagatggagaagtgtagagaacagacatccttatcatcttcctgatcttagggagagagtatccagtctttcaccagtgaaatgggaataacattaattgtaggtttttgtggatgtctctgatcagtttaaatatgtttacttttattcctaatcaggaatgaaggtagaattgtatcagatgctttttccgcatctaatgagataatcgtgttggttttgtcctttattactgtggtacgttactacaattgacagatgttaaaccaactttgcattcctggataatttggtttactcatatttttattgatttttacatctgtaatcataagggatattggtcaatagttgtcttctgatttccctggctgactttgatagcgtggcaattctggccttattggaaaggacaacaactataaaagacaggagggaatcgtttgccacagcttcagttggtagtgaacagtcccactctccccattcacttctcagtattgccatgtggcctgtcagtagaaagattaccttatacttaataccttgacaaaagagcagtagaatggagtctagacggattttctaccacaaaccattcgaatgtaaaaagtatgagtgatgagcttctattatctggcaaatatccatgtataaaagaccatctcctattaaatgctaatttagtttatctacaagtctgtaatattttagagttgctggaatccagtaaaatttccttatacagatttggaaggcagcctaggtgtgcagaatactaaattatctagtttacctttccttccctttctctctcagcatttttctatgttgtaatcattttctttccattttattaacagaggaggaaggaagagacttgagctgttgtgtagcttctcttgttcaagtgatgctggatccctattttaggacaattactggatttcagagtctgatacagaaggagtgggtcatggcaggatatcagtttctagacagatgcaaccatctaaagagatcagagaaagaggtaacaaaatcttgatgcctttttatcagtctttaaggatacacaaaataaaatttgtgtcattaaaagatgaaggggcttttaaaaaatactgtatttagtacaacttaatttccttagtccaaagctaactaatggattagagttcaaattgatgtacttattataaagattatcgtaactatgaaggtgaaatttttaaaagttgtctattgaatttgtctaagtggaaaactactgaaaaaattctgaataaaatactgaaaaacagataacaagcacattggctattttgaaaaatcacttttggaatatcatattttcttaaaatgggatacataggttaagatgaaaagtttgagagggccacctttgcaacagctgtggagttagtggctgcctcggatctctagttaggctgcggaaggccttacaaatatcttaccggccaggcaggtcagtcagatcagtttttagaaggttgtttcagagagcgccatttgacttgtggtgtctcataaaaaatagtggtcacccgctactgcacttggggacacaccacgtgacctaggctcatcccaaagtgttttctgaaatatggggatgttttctggatgctgagcctacaggatcaaccaaacattagagaagtttggttgatggttttgttttgttatataatctaaagaattgtttctaagacatgcttaaacacatattttgctcttcccccttcatatagtggcaacccgctcaactgtgtgctttgctgtttcaacttgttacatgtactgggcaaataagggttgtgatgtttatcacggttgaatgttacttcttgggtttgatagatgtgtatagctcagcttagaaggcaagtgttttaggcttcgatgttttctcattcatctcttctttaacatcagcagtacattttgaagtaaatgtgaacggctgaaggataacattaaatgatcccattgtctctttgtatttgccagtctcctttatttttgctattcttggatgccacctggcagctgttagaacaatatcctgcagcttttgagttctccgaaacctacctggcagtgttgtatgacagcacccggatctcactgtttggcaccttcctgttcaactcccctcaccagcgagtgaagcaaagcacggtaagcaaccctgtggctgtggctacgttttccctgtttttacaactttatcgaggcataattgaagtataattcactgcctatttaaaatcttatgatttaaaattcttactgccattttcagctgaaatttctgaatggattattttgaagacacaaaaatctaggaaattatttttatgaatgaacattttttgttttactctaatgtaaatgttttgtagtaaacccctttaaagatgtaaattactttaaccaccttaaatgtcatgcttttgtatttatatttcacatttgggctattgggtagtaaaaaacaaaagccctgttacacgacatttatttcctaggtcagtaggataaaaagttgtacaaaacaagattattttccttcacgagtttgaagtttctggtcacaattcattgatgtagaggatttatgactaagcagggtctcaagccaaacttgaaaccattctgaaccaaagtgccatttcacccacctcgaaccaacaacagaagctgacaaatgccgtggagaccattgagagaaacagaaaggggcagctcttgtggaccttcaggaagcctttctaggaagaggattgccctcatagtgagctccggggtcttcagcctcagccgtaaggccctgggctaggcagtgtgacctagggagcgggaaacctgagttctggccctggtctgggaaaagtgctaggcccatgttccactcaggcttcagcctgagagtccaggttgctaacctgtaaaatggatctgtcaaactaacacttatgcctttagtctcattgtatgaggtgaaacattttgtaaactgtgaatcattatgcaaattttcctaaagacatatgaattattctggatttgttggtataaaagacaaaacacactggtcagttaaggagctgattttatttaggctattgcaggagggagaacttaattaatgggcatcccaaagaaaaggacaaggcctgggattttatagtcagaagacaggggaatcaggagggagggcagtctcagtccacaggagccagttctcaggacacaaaaggcaggagagattgtccagcattgccacttttggggaacccagggctcaaagaaactcaacaccgtcagcctgtctctacaaaaaatacaaaaattagccagacatggtggtgcgcacctgtggtcccagctactggggaggctgaggtgggaggatggcttaagcccaggaggcagagattgcagtgagctgagactgtgccactgcactccagcctgggtgatagagccagagtctgtcccctgcccaccccaccaggaaagtttgacctttccagatactgtgctgagaaccagtgatacaggcttagaggctcctgaggcatggaacgctcatttgttcctaaaatacatgctctcccagttgcttgtttttatttttcgtcaccataatcattcttggggcccctctctgcctcgagctaggctttccccctggccttgtttgcctccttcagctcttccccattgtctcccgtcactaccccgtgcgcacacagtgtgagcctgcaaaaggtgcgtgaggcgaggacaaagactttggggtctggggactgggcagtgcatgggtgggtatctgcgtggaggactcccagcccccagacaccactgcctctgctgcttggctgatgctgtgtgtgcggacagacttctcaccaggaatgaacattactgaattgtattgagggagctgtaaaaaatactttctacaagtatttcctctgctttccctgttcatgttctagtgctctttttaatttggctctttcaaaagccttttctgacaaatactaacatgaatccccctctcccttcctccctagcaggaactggtcattgtctaagggtcgtgattcttaaccgttctcagccccttccacacaggcaaaagcccaaagcatttcttccttttttttccattctgaggccaccttaggtgctagtggccaggtagtgtttatagaaaatctggtctctcttgggataaatatttttaatttttaccttttaaaaaagagaacatctttttttttttttttaagacagtttggctctgtcacccaggctggagtacagtggtacaatatcagctcactgcaacctctgcctcctgggtccaagcactgctctcgcctcaaccacctgagtagctaggactgcaggcgcatgccaccacgcctagctaatttttgtatttttttgtagagtcagggtttcgccatgttgcccagtctggtcttgaactcctggactcaagcaatccgcccacctcagcttcccaaagtactgggattacaggcgtgagccaccgtgcttggccaagaggacattttctatatacttactgaagggccattaaaacacgtttgggttcatgttttactagatttcagctcttaacagtgtttgaagcaaatggattgtttttaatccatgtacatgatgaaatgtcaagtaactaaaatttttttttttttttttttgagacagagtcttgctctatcacccaggctggagcacagtggcatgatctcggctcactgcaacctctgccttccaggttcaggtgattctcctgccacagcctcccgagtagctgggactacaggtgcacaccaccatgcctggctaatttttgtatttttagtagagacggggtttcaccatattggccaggctggtcttgaactcctgacctcgtgatccgcctgccttcggcctcccaaagtgctgggattacaggcatgagtcaccactgcgcctggccaaaactgttaagagtatgtgtatttggtgcttaatgaatttttacttatttgaaatagaaaattttgtaaaactttacaaaatgccctgtgctgttacacagcttagccatttcttgatgattcaagccgccactgtgccagggaatgccacctggctgtgatgtagtcatggcctcctgactgctatattcttgtcctaataacattcattgtttgcctttttaataatttccaaataaattcttgggggtttttttttggtagaaaatttggagagtactgaaaggtacagaacaaagaatcagacatttcccatcatccagcgactttgtgtctggagttatttcctccagcgaactgttgtgtatacactgctgtggtagcctgctgccatcaatcagctgagatgagagtcctttctccacattgctaaatgtgactgtgcttcatagaaatggtctgggctgccttccagaggagctccatgtcttcctcacaatgcggtggttggctgtcaccctgtagccttgtgttgcctcagtttactgtggtgggaagccagataactaggctgcacccgcccagagtccgggctagaggtggactcctgtgaaggaggggtctcctgtgtacatggtctccatggttttagccacatgctaggaccacagggagttgatcccttccttcctaccctgagtctgtggtctgtgatttgagatcactggctcagtgaagtgtagctccccacttacgaagtaagttataaaattggtggcagtgatttccatccaaagattttgttaatccacttaccaacaggtaactacttaaatgtactgaccgtgtgctcataaaagtaaaatactgtaattatagaaataaattcaacatgtttaagactttctagtatcatgttagtgaaacttctcttaataacattcttattgcccaaagggcacggcttccttggggtcctaaggcagagggcacctgaaaagcacactccttgttcatggggactgtggggccctctgagctcaaaggccaggagcgtctcctctcttgaagtgaaagtgccactctggtgggttttgagggctgcagtacagaacatttaacctgtgtaatgatgagtggctcatctgaaaaaaggcattcatgagagaatctttagttttgcaaatatttatttatttattttgcaggaatttgctataagcaaaaacatccaattgggtgatgagaagggcttaaaattcccctctgtttgggactggtctctccagtttacagcaaaggatcgcacccttttccataaccccttctacattggaaagagcacaccttgtatacagaatggctccgtgaagtcttttaaacggacaaaggtaaatcacagctaacaaaacgtgatgttggctcacacgtaaccaaacacctctttttcagaacagagagcgttaaaagtaaaggcacttccaagagtaacactgctaatgcgggtttctgaggggtcattccctttttaactcaaatgactgtatcccagctttcttcctggtgtctgaggcccacaaagtctcagtacctgagagtgggcagattgcagctttgagcctgcaagcctgatttactaaagccccatttatccatttcttgatgattcaagccgccactgtggcagggaatgccgcctggctgtgatgtagtcatggcctcctgactgctatattcttgtcctaataacattcattgtttgcctttttaataattcccaaataaattcttgggattttttttggtagaaaatttgcagactactgaaaggtacagaacaaagaatcagacatttggcctcctgactgcctctgttcagtttgccattgttcttgatagaatcggccaggtctagtgttttttctagcccgtcttagaacttatccttaagcaaattagtggataggaggtactctcatcccgcccccattcaggctgatagtaacagcctaggtagagtcaacacataaaaaagtgtaattccaggggaggaggattagaataaggacacaaaggaagggaggaaaatgttctttgaggctgaaattccattaatttttcatagtattgagtttatatttgccattgcatccttcaatctttctaaaaagggaatccccggaacataataaaatctcttctgtatagaaaagctacagctccacactaagaggaatgccgtctgccttaaagaatggaatcatcagtgaccaagaattacttccaaggagaaattcattgatattaaaaccaaagccagatccagctcagcaaaccgacagccagaacagtgatacggagcagtattttagagaatggttttccaaacccgccaacctgcacggtgttattctgccacgtgtctctggaacacacataaaactgtggaaactgtgctacttccgctgggttcccgaggcccagatcagcctgggtggctccatcacagcctttcacaagctctccctcctggctgatgaagtcgacgtactgagcaggatgctgcggcaacagcgcagtggccccctggaggcctgctatggggagctgggccagagcaggatgtacttcaacgccagcggccctcaccacaccgacacctcggggacaccggagtttctctcctcctcatttccattttctcctgtagggaatctgtgcagacgaagcattttaggaacaccattaagcaaatttttaagtggggccaaaatatggttgtctactgagacattagcaaatgaagactaaaatagggtgttttctgaacattttgagggaagctgtcaacttttttcctctgaattaacattgctaacctaggcgtttgaatctctaataactttatatgtaagaataatagttggaatttgcactaatatttaaaaacatgttgaatcatgcttctttcacacttattttaagagagatgtaaattttgttcctgtcctctttctgtcattacaggtctggctcttgtaaccgtgatcaaactgttcatgttgtctgctacatttttgtctccatccatttttcctaccacctcctgaaggctatctgatagtcagtcacattagcagccccaggcagcagacaacaggaaagttaggaaatttgtgtttcgtgtcatttttaggagcatctgataaaacctccagcaggttttaggaagtattcatgtatttttctggttactttctgtcgtctctaattgaactcacctgatgaaggttcagtgttctggggccagaatttatgattttagatcaccttctttggaaccttagatcactgtgttttgaaatcatgagtttgcttttaacttcatagggtcaactttaaaatgatatgcactgttaattttaaagcatttgctgcagataattaaacttagaagtgcctttgactttaggatacaaatattacagaagaaaatataatttcactttttaaaattggggtgggaaaatcccattgcatatttgaaataggcttttcatactaagcttcatagccaggagtccccagagtcttgttcctctgaaagccactggggagtggcctctggggtgctgattccacagaggtgtatgctgtagacaggagagtgccatctatgccaaaactcgccctcaaaaacaaacaaggcttgctgggaggcgtgctgggcttggccatcagtatttccagtgtggtaaactattgctggcacttccccctggaaataactaatgaggttacgagttgggcacctgcacagatgtccttctctcatagttcctaatgcttaggaatagaggagaaataaaaaaatggattctctcaaaacactgccatttgaatagcgacagaagtgctcccccagcccccaactttggacagcaaagttgaggagaatgagcagacacagttgtttgcttgatctgaatctctctaaagtaaagtatttccaaactgtgtgacaagagcctacctaccactgtagcggtcaaagctgaagcttcttacagcagtgaaacggggcaccacctcccccacactcctcattccccgcttaaaacatggatactttcaaatttgactgtttcttaaactgccatcctaagatatggaaaatttttatagtaaagtgtctagttagcttatttccttttctaaaacaagtgttttcaagataactgtattttacctttatatgtactgaatagctgtttctttttgaattatttgccttttaaaatttgataatgtctctggatataacaggacaggagttcttaaaaaatatcttaagaaattcactttatgggtaaacccaaggtttttgccaacttgttgcctagaaaataagggctagtttcagtttatacaaatagaattattaaacattttacagtccttgattagaaaccagacccaatctccttataacaccacagcgtatcctgccattgacagtgtaatcacaattctccctttttcatttagctgcttttttattattactaaatgttttggattgagcatttttccctctgtaattttcttccttcacgtttattttaactcttgtagtattttattgttgttaatttacaagtttaaaaatattaggtactattaataatggttaaaaatagaaaaatgcatatttttgtatgataatcaaatgtaaaatacttttatttttgctggacagttgttatatcatgattattgtgctacagtttattgtgcataatatgaaaaacaactatgacagccttcagtcgggccagggtgaagctgcttataccacctctgccgtcagagggacatgtggtgacagcagtggtgtggctgcacagggcgcactagagagagctcagcacccctgctgcccgccagcagagcccgtgctgagggaatgccgcacagatgctgatgcactgggtgaaatttctagtattgaacgtaaaggtgtacagtgtcttgctgttattttatgatggaaactgattttgaaaccaaaaatagctaactaactttatttaaggaaaggatattaatttgtactaacagagggtgaaagctgttcacatttgtcaacaaaatctgcttgctgcagtagtaacctcaagtggttaaaacttgatttcccgagaaaactaaaacctttgtgcctaaaattgatgacttgagttcaagtgggatgagcaagaagatgtgttatcttgttgttcaacagtattgaatgtgaaggaaattttgatggcttaataaaattccacagcgactgtt

SEQ ID NO: 49 - DNA, 100388 bp, Homo sapiens
gccctggccaaggaggaggctgaaagagcctgagctgtgccctctccattccactgctgtggcaggtaagctcagatgcgggtaagcacaggtgaagggaggtcaggtgcaggtatcctcaggtgtgggtaaactcaagcgtggacaaactcaggtgcagataaccacagatgcagttaagctcaggtgttggtaacctcaggtgcaggtaggctcaggtgcaagtaagagcaggtgcaggcaagctcaggtgtgctttctggggcctgttactcatctcctcttgaggctggctggacaggaccctatggagcagctggtgaacctgtgttcagcctgggttccaagaggctgtctcagcagaagggacccaccaggttgattcacagaggggataagtactctgtcagctggtctcaaagaggctgaaaccctctgagcttccctcagggccagcttctaaatccaggtgccagggatctgctcaggagccccggctccaggcctcaacctcttgcctgtcattccttagcatcttactttgcttcagggaaaaggtgcaccttccttagaaccccagaaaatgctgaagttctaggagagacagggtttatacttgtaagcctttatcagctgatatttcacctgtgaaagccttggggaagagattggttacacggaacaggatcaggaggggagattactgctccctctcactgctgggagcagtgcaaactggtttctggaaggcagttcaacaacatgcagcaaagccctgcaagtccacacctaggaacccatcctgaggagcgaatcctgaagggatgccaacattgacacagctttgtgtgctaccgggaagcacagcaaacaacccaaacgcccagaagcagagggctggacacatcaatcatggtctgtccataggatgaaacatcacgcagtcacttttaaaatgacagagaaaaaggcataataaccgtacagaattattgtgtttttcattacacacacatgcacctgtctaatctattcacggaaaaagcctagaaatacaaggaaatatcagttgttttaggatggaggccttatgggtggtgtttatttattcttttgtacatttctacattttttgtcttctttaatcattttctatcacaaattaattttcctttttttcccagaaaatatatcttttgtactttttattagtacatcatagttgtgcatattgtgggggtacatgtgattttttggtgcatgtatacaatgtgtatgtttttttaaaccttagcaaaaattagcaaaagtagtgggggaggtagggaggaatgaaaatatttgcagggccaggcgcgatggctcatggctgtaatcccagcacttcgggaggctgaggcaggcagatcacgaggtcaagagatagagaccatcctagccaacatggtgaaaccctgtctctactaaaaatacaaaaattagctgggcatggtagtgcgcgcctgtagtcccagctactcgagaggctgaggcaggagaggttgaacccaggaggtggaggttgcagtgagccgagactgcgccactgcactccagcctgggcgacagagtgagactccatcaaaaaaaaaaaaagaaggaaagaaagaaagaagaaagaaacaaagaaagaatatttgcataaattgtgtttgcgttgacaagggataggaactgagaatggggaaggaagatgagacacattttctctgtctgaatcagatatttagggaggaattaagaacggagccctgcctctctatgagtgcacttgatgaatacgggactgattctgggaaagactgcctttggtcaggttctcaaaacaccattgttttgaactatccagcagcagttttaattcatggcatttgcaattatatttatagcataaattgtctattctctgcagtgtattttttagccctcctcccccagaaaatgtaattggaaatatcaactcatgttgaatgtgtttgctgtacctgtttatgttttattgattattttctgggagaagtttggagttgtgtttggtttggctctgtgcaacctcatttatttgctctgtaaagctgataagcacaagaagtgaaatgacactcaggcattttaagatgcgagtcatcttcattctgaactaagtgaaaacaaaacagattttctatcaacctaaaatcctcctactgggggcagtagatgtttttagaaaattggctttggctttgattgacaatgtttggaagatgtcctataatttgagagtgtatgtgtgtgtgtctgggtgtgtgtgtgtaaatgctggacctgggaagatggaagccctcagccaggagaataagaggacacaatacccccaagccttccatgacctagagattaaggggatttaacgtcttaaaacctccattaagtagacagtagcaagagacatgttgccctcagtgatatgcaaaggcatatctgatgggtcagtatctgccatcctcctcttttgcaagctctgaggttagactcagccatgggtgaaggaattacagcatccattgggagcaggcagagtccaggaaagagatttttctgttacctcagatgcccatcgcgccaggagcaattttcccagcctcttgtagaaagcacatattagtatctatctcactgcttttcagaaactgtatcttcaattgctaagtggggaaaaatgcatttacaatgctagagctgactttaagaaaacaagttaacatcaggccacagcactcccctcccccgctgctgagaccttgtcgctgtgcaccttgtcccctccctcacggcttctggctcccgctcccccaatccctggccccctgtctgcccctgccattaaagtggcaagcacaggtatcctcctccctcatcacaacttatccatcctgtgtctgctcccccagggtgggtaatgcctgaaatgccttaaggtaggggtaacgctcatggcaggtggccctggctctcctggagacagggcacaggaatgggcaaattcttcaggcttggtgaggtggaaagcttgctcctcgggaatcatggccacagtgcccttttttgtttgttaatcattaaaaagcatactacatgaatatataaagttggaaaaccccacagaagagccaagtgaagtcctgcttacacactcctcctgatccctactctcccgtgctgtggaccatgcttagtgtttgacgtgtattattattatttttgtgtgtgtgtgacagagtcttgctctgttgctcaggctggagtgcaatggcatgatctcggctcaccgcaacctccgcctcccagattcaagcgattctcctgccaactagctgggattacaggtgcccgccaccacgcccagctaattttgtatttttagtagagacaaggcttcaccatgttgatcaagctggtctcaaactcctgacctcaggtgatccgcccacctcagcctcccaaaatgctgggctgggattacaggcgtgagccaccacgcccggcctgatgtgtattattctagacctctgctgcctaatagaaatagcacacgcgccacagacataatttcaaactgtgtagtagccacttaaaaaggaaaagtaaaaacaaataagtgaaattaactttaattctataattcatttaacacaatatatctaaaatatgattgtttcaacatgtagtcaataccaaacacatactaatgaggtattttatgtctttctttattgttctaagtctttgaaatcctgccacacacctcgttttcagctctcatgtcacagtgaacattagcgtgccatctcacactcacagcatgtctccattcaccctggccacatctcaggtgcgcaacagccccaggtagccagggtctaccatgcgggacagctctgctcttgaatatcgggaagtttgttcctgtagagctggatcacatcggaaatattttactacgctttttttttcaattcataatggagacgtttacactttagagttctgtgttagtcttgttcatggttgcatagtccatgatttggtacgtcgttaattggtttaatcagtcccccaggtagactaacaaaaaagtggaggtttccaatttttcacttagcttaaaatacactgcaacaagcatccatacattgcctatttacatgcaaaagtatttccaggtgatcgatccatggaagtgaaagtgctgggtcaaagacaggcatgcaccctttgctctgagaggcaagccagtactcagccaagccggccaccaatttgccttggggtttggacgttgttcccttagaggtaaaagcaaagagttgggctggataccctccatagttcctaaatgctcagttccatggcccaaagggtggtgattcctgccaatgcctttggtggacgtagtcttgggtgggtgggtgggtgacagctacctgctcccactggagggcaggcctggattgggcagataagcaaatcaaccacacacaccttgtctagataagcagaaaacactcagaaaagaccccaattgttttatttgtaaaattgctctttggctaattttcatgaatgtggatcattcattaaacgttatcatagaaaaagagcagagcaacaaaggggcccggcagtctgattcccgtgctggcagcctccaccgtcacgctgagctgtggtgaatgcctagggtttcacccgcctacccctcactcctgctggcgtgcaccctttccccaccctggtggccccagcaaacatcacagtccctgagggccaggaggcttgggtccccagatgcccacacctgacaggcctagtgcctgagcactctggtgagggacttccctggaccatgggagcactgccagaggaggctcgagggcagggacctggatgggtagcaaaggacagagaacatcgggaaaggagagggtactacctgtgggaaccaggcaggcacaagaggctggccctgagcctctgcgcatctctcctgcagacactggctgcacctgcctagcctctgaaacccagaccaggcactcaggcaatgaggggagctccttaacacaacaccttcccaactgctgtgcttttcggagtgagctggccaggtgatgttggccaaagcaggaaggggagctgttgaggtgccccaagatccttgctggaatcctcaggttcccagacaatcagggtagacccggtgatgggagaaggagatggggacacacatggatccgaagctacaagattctgcttctctctcctgtttttgtttattcttttaagatgttttattgctaaataaagcattttaaaaagtgtataagatgtctgcacatagtttagagaatgataaagcagatccttgtgttttaccatggggccctttcccactgcactccttccctcccagaggcagcactgcctgacttctgcctggctcgttcctgcctttgctctttctttctctctttttccctcccttcctccctcccttccttccttcttcccttcccttcgtttcttctttttctttccttccttccttctttcttttcttttcttttcttttctatttttatttttatttttttgagacagagttttgctcttgtcacctaggctgaagtgcagtggtgctatctcggctcactgcaaccttcacctcccatgttcaagcgattctcctacctcagcctcccaaatagttgggattacaggcaactgccaccacgcctggctaatttttttgtatttttagtagcgatggggtttcaccacgttggccaggctggtctcgaactcctgacctccagagatccacccaccttggcctcccaaagtgctgggattacaggtgtgagccactgcgcctggcccctggcttttctttatgtttcatttagtttagttttgaggtttacatattttttatatttatttatttatttattttcaaatggagtctcactctgtcgcccaggctggagtgcagtggtgtgatctcagctcaccgcaacctctgcctcctgggttcaagctattctcctgcctcagcctcccgagtagctgggattacaggcgcctgtcaccatgcctggctaatttttgtatttttagtagagacgaggtttcaccatgttggccaggctggtctcgaactcctgacctcaggtgatccacccgcctcggcctcccaaagtgctgggattacagacatgagccaccatgcccagccatatttttaaataatttattgagatgaaatttgtatcacataaaatggaccattttcaagtgaccaattcagtggtatttagtacagtcatgaggtcatgcaactaccttgtctctctgtccttacttccaacactacaaagtaaaaccccctacccattaagcagttcctccccatttcctctccctgtggccttgcccctggaaaccactagtttgtgctttgtctgtatggatttatctattctggatgtttcatctaaatggaatcatacatatgtcaccttttatgcctggcttctatcagttagcatcacgtttccaaggttcacccatgtggcatgcttcagaacttcgttcatttatgtggctaaataatattcttttgtttgtataacatataccacaatttgtttatccatctatccactgatggacatgtgagctatggccaccatttggctgttatgaatagtgctgcaatgctacatgtttatttgagtctctgttttcatttctcttgggtatatacctagcagtaaaattgctgggtcatatggtaattctacatttaactgaggaactgccaaatcattttccaaagtgactgtaccattttacactttcaccagcaatgtctgaaggttccaattcctccacatccttgcaaacactggttactatttttttattttgggatgtttttaattataatcatcctagtaggaatgaagtggcacctcatcatggttttgatttgcttttccctaatgtctaaagatgttgggtatcttttcatgtgtttgttggccatttgtatatcttcattggagaattgtctattcaagtcctttgcccagtttttaatcgggttgtctttttgttgttgagttggaagagttcttttatatattctggatattagacccttgtcatattttgatttgcaaatatcgtattccattctataggttgtgggtttttttcctttcttaataatgtcctttgatgaatttgatgaacagtttttcattttaatgaagttcaacttacctgctttttcttttcttgttcatgcttatggtatcatatctataaatccatcgatcatgaagataatgaaaattcacacatatattttcttttaagagttttatggttttaggtcttacaatttagtctgatccattttgagttaatatttatagctagtgtgaagtaggggtccaaattcattcttttgcatgtggatatccaattttccaagcactattagttgacaagactgtcttttcccccattgaatggtcttagcacctttgctaaaaatcacttggacatagatatatggacttatttctgaaatctcaatcttactccactggcctgcatgtctgtccttatgctagtaccatacttctttgattactgacgctttgaaattctgaaatcagaaaatatgagtcctctaactttgttctttttttcaagattgctttgtcggccatgtgcggggatcatgtttgtaatcccagcactttgggaggctgaggcgggcagatcacttgaggtcaggagtcggaggccagcctggccaacatggtgaaaccctatctctactaaaaataaaaaaaattagccaggcatagtggcacatgtctgtagtcccagctactccagaggctgaggcacaagaatcacttgaacctgggaggcagaggctgcagtgagccgagatcatgccactgcactccagcctgggcaacagagcaagactccatctcaaaataaaaaaacaaaaaaaaaaaccagattgctctgtccatttagcccattgcaattcatgaatacaggatgtctttccatttatttatttatgccttctttaatttctttcagcgaggtcttgtcactttcagtgtacaaggccttcacctctttggttaaatttatttctagatactttctgatttttgatgttattataaattgaattgtttttgctgtacagaaatacatccaatttttgtatggtgatctttcaccctccacttctgctatattagtttattagctctagtagcttttttgtggattctttgggagcttttttaatcttttttttttttttttttttttttttgagacaaagtctcactctgtcgcccaggctggagtgcagtgtcataatctcagcttagtgcaacctctgcctcccaggttaaagcaattctcctgcctcagcctcctgagtagctgggactacaggtgtgtgtcaccacacccagctaatttttttatttttagtaaagacagggtttcaccatgttggccaggctggtctcgaactcctgacctcaggtgatccacccgcctcagcctcccaaagtgctgggattacaggcatgaaccactgtgcccggccccttattgttttattttgaacttcatctgtatttctaaataatgcattgttgagcttcacctgcttttgaactttatacaaatggaatcacactgtgtgtatctttgatgactcatttcttttcttctgtgctgtgtttggagagtcacccatatggtagctgcagtttgtctgttctcgctgctgtgtgatattcctgcgggactatacggcaatgtacttgtacatgctaccgcggctgggcatctagacggctctgtgttgagtgcttatgaacagtgcggtctcctggaagatacatacatgcacaagtatatttccagtaaacctcagtgtggaagtgctgggctgtggaggatatgcctgctccacttcctgagacaacgagaaatcgttttctgtcctcctgaaaggggaaggctcaaaagcaaatgcccattttggagaaaacattttgaatctgccaaaggagaccctgagtaatgagggacagggctgggggtccaggtccggctgcctggccgcgtggtcggcctgggctggtggctccactgtgaccctccatctcctcttttggtgccactcgcctcccagagcccctaccaaaaccctaactcatccacagccccagtttcttcgttcgtaaaaccaggagagctggtggtctctgcagacttacaacgcaccgacaccacacctttattctgtgggaccgtcacggtggtcaccacagttaagaaatgagaccctgcactctgccttgcccctgctgttcccactcccaagagcattttccccagagctcctgcctggaccaatcctctcatccttcagggctaagccagtgtcccaccccaccccaccccacccctcaagagcctcctcagtccagagagaaaaactttctccctcatcccggcccctcctagaccactttatgggggcttgggcccacctgggagctccgaagggctgagtccccttgacatatctggagccagcagagcccacctcgtaagagggctttgcaagctaacagttgagccacatgcatgctgggctttttgtgtgacattcaaagtggtccaggttacaaaggccccactgaacttttgaagaaggtgttttttgttttgttttgttttgttttcccataatcctcccaagttttacaagctgagttgtgagatgtgtgggaacgttcatctataaatatatgagcagcccagacactgaccatgagtcactggtcaccacagaccacactgggtcaggacagccccagaggaacacagcgcacatgtgaacctctttggggggttctcccgccctcaccaccaagtgccactccttattcttctctgtaggaccactcccacccggtcagcctcccaggaacaacccctgctgctcccaagcccagcccttcaggagtgcccctccgtgcccttccctgcccttcggatctgccccatcctgggtctccatccctcagagccgactgcagctaactggccaacctgctaaacaggtggtgctgagatctgagaggcgcttactgacttaacatgtgcacgctggtccccagcagccccagaagtccatttaacatggatagtgacatcgtccacaaagggcagagtgggcaaatacttgcaaaagccttggaaaaacacaaaccaagatttacgtccagcactgttagggctgtgagttctggagtgaagcatctctgtctcattgtgtccgatctccagcacagcaggcgaggcccgggtttcactctcagctctgccatcccactggcctgctgcttcctcggccatggatgagggaattgcagacaatgtcatcagtccacccaacctacccaacagatcccaggcattgaaacagaagcagaactattaccctcgttgcacttttttttatcagctaatgcttaagaaacttcaaaactgtttactgaatacaatcgctgctagacattgggcttgaagttttacacacttaatcacacttaatccttacagaaaccatgagaaatcagcctcattactccatgtcatagacaagctaatcaagactcaggaaagttaagtaagttggccaaggtcataaagataagaaatggtggatctgggagctgactcaggtacgtctaaagcccaagttctccttccaccacactgtttactgtattttttttaaaaaaagagccactttcaaagcttaaactcgaagaaatggccttaatagtaaagctttccagcaccattcagacttgttgggaagattttttccagggtgcagtttcttttttttttttcttttttgtttttgagatggagtctcactctgttgcccaggctagagtgcagtggcacaatctgaggtcaccgtaacctctgcctcccaggttcaggtgattctcctgcctcagcctcccgagtagctgggattacaggtgcccaccaccacacctggctaatttttgtatttttagtaaagatggcatttcaccatgttggccaggctggtcttgaatccctgacctcgtgaccggcctgcctcggcttcccaaagtgctaggagtacaggcatgagccaccacgcccagccccaggatgcagtttcatatggaaaataccacatggaatcatttctagaaagcaagaatcccggggacagccacaccggagaacaccatgcagctggttgaagggtgaggaagctgtctgtgtaatggctcaaaaagactcccataaatgttgctaaagtttccttttaaaaagtcctttacgagagcatgtgtgctgagaaccaggaagaaatagctgaagggaacgcaccagtgttcatgggggttactgctaggggctagggttgcagaggaaaaaaagataatcacttttttgtttcaatatttccgtatacttttaatttgttccattgagcacatactagtttagggttttttcatttgttttaaattttaagcaaagaaaaaccaaacacacacacaccgtagtcacttcccacccccacacggtgctcccggccaacccaggatcctctgccccaggtgacatcagttccctgtgcgccacatggcacagttatccccttactcacaagggcaggcagaagtgccttccgcggtgttctggggcccaaaagcttatgcactttggggacaccatgttgaggaaaatgatactaacctattacaagtctaaagcaagctccaggccttggagaggtcatccaagtgtcggccctggagctgacgcttcctcaatcatagggtgaaccgtcccagggtagctgggcctggacccgtctcatcaattacaaactctcccgagccagtgaccctgggcctcctcgagttacagagcaaacggtgccgctcaggcctgtctcggccccccatccaccgctgcccgggaatgtgctattgcacacaggcctccccagtgttctccagcagtgttgtgggccagcactaaggtcagcaggccatggtcaccaatgacctgtcataggcatcaagccaaatcctactggactctgtagggaagaaacaacgtatacttcatagatacttaccaagatagcctcccggattttgaaccaagtgggaaaagttaacaaccaaaaaaacataactatatataaaccctcccgggcaatgttggcccaccattgccaaccctcagaaacccacccagtgggggacacgctggccacatggtcagagaattacgaactacctagaaatgaccactcctgttgcacaataatgcaacaccagaaggcaaacagcagcagcctgtcttcagtttccacactgtattcatcacgaattttctgtattgatttttgttttttaaaaatatggcattaaatgttacttatcctaattactggatttctgatacccccatttgagtgcctcacttgcctcaccctaaatctagaactgcccatcagccaagaaagtgctgggagccccactgcctcacagaggcgccagcagcttccacgcaattctgccaccagacttctggtaggcaaacactgatctcccgctcgggggggccaaatgtcaatacccgcagcagggcttatcgcatcgccccggtacaaaggcctcctctgacgcatccccccagcagaaagaacgttcaggtgtttgataccatggttgggaacgttcccacaggtagcaggaagacgaataccgccgcttcagtcaatctcatacgacggcccccaaatcccaaaaaggcttagtatgaaatgcccatcctagtccgtgagtgtggcatgtccgcagtttgttccttcagatgtttcctacgtttcttccttccggtgggttcttggccttgctcacttcagcagtgaagccgcagacttttgcagcaagtgttacagctcttaaaggtggcgcatccagagttgctcgtctttccaggtgtgttcgtgggcttgctgacttcaggagtgaagccacataccgtacagtcagtgttacagctcttaaaggtggtgccaacccagacactttctgcttgcagcaataacatttattgccaagggagaaagaacaaaaagaagaaagcttccacaaccaataaggagacccgagcggattgccagggctggcgctggtgaccagcttttattcccttatttggccccacccacatcctgctgattggtccattttacagagagcagattagtccattttaaagagtgctgattggtccgtttttacagcgtgctgattggtgcgttacaaacctttagctagacacagagtgctgattggtgcatttacaatcctttagctagacagaaaagttccccaagtccccacccgacccagaagcccagtcggctgcacctctcacaaggactagagtgaagcgcagatagctgcatttcttaaaaagttgttttaattgtggtaaaatacacataacataaaatttaccatcttaccagtttttaaatgtacagattgtgttaagtacattcacattgttgtgcgaccaatccccagaactcttttcatcttagaaaatggaaaaactacccattcctccctcccaccagctcctggcggccaccattccatttcctgtctctatcagtttgactgctcttggtaccgcacatcacacagcaattgtccttttgtgactgacttatttcacttatcgccatgtcctcaaagtccatccctgttgtggtatgttctgaatgcccttcctgctgaatcatatttcattgtgtggatagatcacattttgtttatccactcatctgtcgatgaaaacctggcttactcctacctcttggctattgtgaataatgctgctatgaacacaagtgtaaaagtccctattgaggccgggcatggtggctcactcctgcaatcccagcactttgggaggctgaggcaggcagatcatgaggtcaggagattgagaccatcctggctaacatggtgaaaccccgtctctactaaaaatacacaaaaaaattagcggggcgtggtgatgggggcctgtagtcctagctacaggactacatggaggctgaggcaggagaatggcgtgaacccgggaggcggagcttgctgtgagccaagattgcaccactgcactccagcctggggcacagagcaagactccgtctcaaaaaaaaaaaaaaaaaaaaaaaaaaaaaaatccctattgagacctgcttaactgctggatcataggataatcctgtgtttcattttcgaggaactgccatactggtttccacagtggctgtactcttttacattcctgccagcaatgaacaagttttccgatttctccacatcctcaccagcacttgttatttcctgttttttcagagtatccatcctaatgggcatgagatagtatctcattgtggttttaatttttagttccctagttaagatgagtgatgttgagtatcttttcatgtttgttggccattcatacatcttccttggagaaatgtgtaaagtccttttttaaatcagtttgttcatttgtttgctgttattgggttgtaaggtattgtaaatattaatatattttaaatattaattgcttatcagatatatgatttgcaaatatttctccacattgcataggttgtcagatatatacacttttaacaacctcccttagaccaggggagaaatgctttgaagaacctggcacaggatctgtgggcccctttctagaagcaagtttctgggccaggttccacctaggagcagggcccaaggggaggagacagggaggagtgctggctccactcagaccctggagcccctgctgggagaggtggggatgctgacctaggcacccacaggcacccagaagccagggcctcccccatttacagggcacatcatgtccctggtcaccacccctcgaaagagcatgatgccaaaaagcccgggctgtgcctgggtcccctctgcgatggggcagggggctgcacacatctgcaaggcgcagcttgtgttagaagcacctgcctggcttatctccatgtgactctgtaaatggggagcagtggagtctgataccagcaggtgctccaggcatccagtctgatgcctcgcaggagctccctgctctgctagctccacctgaggggctagaggccaaccttgccgctccccctctcctcccgtcccttcctcccagcctggtctgatgccccatggttctccccacagcccccaggtgttccccagtggtcccacccttttcttcaggtccagcagatgccttagctggagttatctgcttatgacagcccttgtttatgaccactgtgaaggtagttctctgaagggtgagagaattagataatccaacacccagcccagttttcctttgcttttctcctcggaacggtcagagatcagtgatcgtacaagttagtcccacaggtcttccttccaggacatcctacacccatcagtctgggcctggggtctttctctaagcgtgaggcctgtggctgcgggtccagggtatcttttctgccagtggtaaaaaatgagaagcaaatatcaaaagattcaaaagcctgaccctggctgctgtctgtgtccagccaggataattcggggtctgcattgcagctcttctgtttttgtttggttttgttctcctaattgactatttgcactaaccaggtcagggctaactagtaacaccctacattctgcacaaaaaatcagcaaccccatgacctgtgatgagggtggcctggcaggaggcaaaagcgacaagcgttcctggtatctgaccagcaccaccttgaattaggacatcaacacatgcgattggactataaatcatgtaatgacaactgcaatgacaactctaaaaacaattgggcgtgtgctcacattttcacagtaaagccccgacaatgttgacaaaatccactgtttgaattctgatacgactttcttccattttgtgatctttttattgctcttaattacaacggttagcattagagacataccctatgattccattatttgcaattgcagcttaaatatgcatatgtcctaaatgatggaatgataaccagcagtgccattggaaaatgaaaatattagtgatgctgcagaaatgccaaggatgtaaccatgaggctggactcttggaactggccatagctggggagaccttggactgaggcaccctggtattggctgggtgaccctgggcacattctcctttttctcttttttaaaataagctatgttggtctttagaaaattaaaaacacaacacggacaatgaagaaattaaagaaaaagtctgtatcccctcccacaaacacaaaatgaacaagttaatgaatttgcttccttttttcctagccatattttgtattcactttaaaaagaaaaaatgttggctgggcacggcagctcatacctgtaatcccagcactttgggaggctgaggcaggtggatcacctgaggtcaggagttcgagaccagcctggtcaacatggtgaaacacccatctctactaaaaaataccaaaaaaaaaaaaaaaaaattagccaggcgtggtggcgggcgcctgtagttccagctatgcaggaggctgaggcggggaatcacttgaacccaggaggtggagtttgcagtgagccaagatcgcgccactgcactccagcctaggcgacagagtgagactctgtctcaaaaaaaaaaaaaaagaaaagaaaaaagaaagaaagagagaaaaaatgtcttactgatagcactattcacaatagccaaaagtggaaacaacccaaattcatcaactgatgaattcatgtaatggaatattacagaggcatagaaaagagtaaagtcctgatctgcgctacctggatgacccttgaaaacatgacgccgagcaaaaggagccagacacaaaaggccacacgttgaatgattccattcatatagagtgcccagaataggcaaatccatagagacagaaagtggatttgtggttgccaggagctgggcagggtcagggaggaatgaggagtgactgctaatgggtaccggctttttttaggagtgatcaaagtgctctggaattaggtagtggtgatggtttcacagtcttggaactatatgtaaaacactgaactgcagactttaataggtgaattttagggtatgtggattatatctcgatttttaaaaaagaaagtacaaagaaaaatatcactgtctttaaagatccagctctgtttcctggactctagtctagaggaggatctctcagtgtccccagaggagagcccctgggagagaagaaggctagaaacccggaggaaagggaaccctggcccaggagaggggtcggctgtgacgacctccagcatttcctgcaagccagccctgtcaccttcctgcggatagtgatgatgaagcagaggacaataggtttcaaaggtcttccaagcatggtgtcactaggctctcacaccagcctgtggggcagatgtgaggggtatcattgtcctcattttgcaggtgacgttccacaagatgggactgaggtgaccctcagctgggccctcctacctgtgctctctgcagctaggggcaggaggctgcatctgacctgagagtatccctgagaagccagagcaggactctcagctgaaccacccagaaatggccagttggacccaggccaggacctccagtggcagtggagcgagggggtgggagggtggagcaggaaggagtggttgtggcttttaatcctttctgcatataaggctgggcggcttgtgctttggctggcaggcttgtttgattctcctgcatggagagtttcaggcatgcaggtgccaccccaggtggggcccacaggtgcccctaggagccgggcaaaggcaggtcccagggagctgtcagggcacatgtgggaacccgccgccacctgcagctgtgccaggacaccagccagcgttcccacatcctgagggctttcaagagaagccataagtataatctccctcttggttaataatggcagctaaatgtagttttcacaaaaggttccaaccaagcccatatgtgggccacatgtagctgtgggaatgagagtttgagtcgtctgctctaaatatatacacaaaacaagcagtttcttctggataaactggtccacacatcattcatttcattgcggggtttgcttgttaattttggcccaagacatagggctttgagtaaacagagcctcgcccggcagtacaccagctcttacattcagaagccacttccccgagccatgtcctcccagaccaaagtcacactgtgtctttgcagccttcctccttgtctccgtccagccttctcaaggtatccccctgcaccttcctgtacccctccttgtgggtcgcccccacctgtgtgtgtaaacaccttctagaaggtcacattgttaaagccccccatgacccttcattccactccagctcccaccatttctgggctccccttcaggggaagacttctcctcggggttgacacttgctgtctacacttcctcggccccctcactctaaaactacgtaaatgcccagagaataacatgacaacgtgcacctgagcaacccccacccagatggtacaaaggtttccttggccatgtttgtagcagatatttctttctttaaaaaataaataagtacagagctggcagaacatttcccattgcccttcagcccactcctcttggactttcttcccgcagcctccccgtggcccttcatggacacatggtcctggctacagatgaaaaatcgctgggtcctcagcagggcagtcatatttgataatgaccaggattgcatttaaatctagtacctcccagatactgtacagataagatcccagctaaggctcaaaaccactcaaagccatttccatttcagagatgagaaaatcacagctcagaggggttgggggcgtggtggcagtgccagcagtccgcctccagtatgacctccactgtcccttcactcagccggggtagacagacttcccagctgggacaagcactcttaaaatctcagtgggatttccatctccagtgccagtgctcctatcatccggcacagaggcattcaaaataaccatttctgatggactggaatattttgcacaagtgggcagtatctcacctaatgggggtggggaggttatgaagggtttgtgaacaaaccacaggaagccctgctttctcctttcacaaggacaggtggcacctgcagggtctcccctgcagtggcgttatcgttgcactgaaacttgcatgaccaatctgtaaggagtcagggtgggttcagccatttgttatgaccttggcattgttcagccccagagcctggcaggaggggaaggaggaaagtttgactgaggggcctccacccattgcctttcacctgcacactgcctctgagcagattcaggagaccaagctcctccccaggtgagccatgcctctcctggggtgacctggcttacttcatgtgtgccctgctggcaaatgctctgctgctgtaggtggcattagcaagggctgagcaggtggcactgctccaccgggaggttgagtaaatcactgagtcattaggagatgttgagctctcgccaggccctcctggaggcacaggggatacagcagagaactgaagggggctgctgcctctgtggctttggtgcgaggttggggaggaggggacaggcaggaggtgggggagaaggtttatggagaacagagcgcaggggttggggtagatggggagtcagggagccctggtgaagaggccacattagagcagagactggaacaaagggagggcaggatttgttcatcttgcttcccaagaaagaggctgcaggcaaagtgactcttactcctcttgtttatcctcgtaggttctagaagatttctgaggactcagcagtaacttgcagtgctggactgaggctatttccttatatcaactttttgaaaactcatggttaatacctaagtaaagcacttccaccttccccccctccccccctgagaaagtacgttagtcacatgctagcgtttttattaggaaaagacggatttccagtgaagcagagggaagtggattgagcctggctcgggccatggcgccagttgcacttgccctggtgccgagccacagcaagggctggcactcggcaccatgaaaagccctccttttcggaatctgggggacaaaatgcaagaccgatgccccagagtcatcacagatgaccttcattggcacgataaggggggggacagggggccctgccttgaaggaggcatctaaacaccccttgtgatggaacagacttagccacaaaagccagcgaggggcacgttgttgctccctcatccgccggtggcattaagtcctgtagggcaggctgcgtttccccctttcacgatgaggggcctgagcctaagcgctcggagcctgggctttagtttctgattccccacgctgtgctggcacaggtttcctggacagcgccccagcgcgggtttcttatcctagggcggtgagaggggctgccagggaaagtgtgggaaaggacgaggggcgggactatgagagggagcggggctgggggcggggcctggaggaccgggctgagagggcgggaccgtgagaggtaacagggggcggggtgagggggcggggtcgaggacgatgggggcggacttgggggcggggcctgggggctagggaaggacagtgccagatcttgtgtccagcctctggaatcttccctcagttcttccttgtcttttcgtggccttgacgtttttgaggaacgcaggtgggttatttcgtaggatggccctcagttcgggctgtctgatgatccttcctccagatcaggttcagatgatgtactttgggcacttttgttcctcttggtgcgttttatccagagcctcataataaatatttgttccatgacaggcgatgtgcactttgttttaggtggttctccccagaattctccactgtcaagttactaatttctcctttgtaattaataagtatccatgggaaatactttgagattatgtaaatacgttgttactcttcagacttttacccactacttttagcattcatcagagattcttgatggttgccaaatggtgattgtcggattccatcattccttccacatttaatagggactttccactggaagaaagagctttctccctcccctgtgcgtttatttacatatgtatttatatcagtgtggacccatgggtctttatttaagtctaaaggttataattcttcattgtagtcatttattttcatgctgaagggaccccagagaaagccactgggagccccttcaagcagccactgtgttcttttggcatgttcccatgtcaaaagtaaagtttctcacttgctggtacagtaaggtgttccaggctcttcttatacttccccgccccagccctggattccttttagtggagaatggtatttggaaaccagtattggagcatgagtatgctcattgctattgaagtgttattgtgaagcccattaagggagccagggaatgtatgagtgtgtaagcatacaggcatgcatgcatatgtgcatatgtatgtaggcatatggccccaaggtccctgcctgctgatatgcatgctttgtgtaaccccctcccttgagtgtgggatggactgagtgactcaatgctaatgaatgggctacggcaaaagccatgggctgtcactttggacaccaggttataaagagacctggcttctgttttgcatgcactcttttgcttgcgcactcagagggtggtcagctgccccttcgtgagctgccctggagagcggtttccctggcaaggagttaagggaggcctgggccaacaaccacatgagtgagcctggaaacggatccttccaggtttccttccttcccttaagaccacagcccccacccatagctcagtcaaatccttgtgagaaaccagagtcagaagcacccagctaagccacattcaactcctggtccatagaaactgggagataataattgtttgttattctaagccactaagttttggggcaatttgttttgttactccatagttaattaatgcaatatgttatatctctatatatgtgtatatgtatagacagggaccacacatacatttatatctgtttttatacctgtctctatatattacaaaccatgagttcacactgataactttaattttagctcagtgctacaaggttcattgtgaccttccccactttccatatttgtaactcctttctccagcagtgagaaacccagctccaatcatctgcaatgtattaatttatttgttcagtcctagaggacacaaaaacagcttcagaattgctatcctatgttccagaaaaagtaacctactcatgggagttcaatctttgtttagagttcttgtctttagttgtcatatagtccaaatactgcaacccctatgttataaaaaacaagggcttcccagcttctctgggaagtaaggcatgagatgcaaaggggaaaagcacagtttctttccaggcagcaggtgctgggcttcgctgtcttgcgctggagaagtgcgaaacagacgggaaaagtgcaaaacagaagggcagggcggggcttcagaggctcccgctccatgctttctttctcccctgagcccacactgcctgcctcccttgcattagcacaaaagcaccaacctctgaggccagcgatgttgtttttaaacagtcattaaattatttacagagaaaagtgtacggtgttgctttttgaaggctactgaggaaggtttgaattttcatcatttctattattcaaaaagccaagtaacaagccgacttggatcttcccagaaaggctgagtttggggggtacttgcacgccctagtccgcacagctgggactagggctggggctctcctagagtaacaaatggggcatcggcatgacctctctgcggagggcctctctgacatgcagttgtcactgcagacctctgcagaggtgacctccccagagacaagggacctcccagagcagcactgctgcttaggtaaatggggacagccaggaggccagctccaagcctcaccccgcagatacctcagtcccatcctggtcacaggcacatggggcactcctcatggcagttgtgggaaagtggccaaggacacaaggctcccgccggccatggtttctctaagatctgactcaggattgtcacatgctaagcgttctacttccccatgcctgcaagcaccccacaagctccccacagacatacacactacacaggtcatagtcatgcacacgccacactacacaggtcatagtcatgcacacaacacactacactgcacacataccacacacataacaccacacacacatcacaaacacacaccacacatgcgtgcgcacacacccactcacatacagactcatcacacacacacacatgcatcacgacacactctgcactcgtacaacacacatccatcagacacatacacaaacatagcacacacacacacacatcatacatccacaaatagcacaaatacgcactgagccaggcctcatggagatccagcgaagggtgctggctctctccctgcctcccacgagcccttccagggatccccgaggcccctgccccacagcctgcctgcacctccctcccacctgcaggaagggctctccccagctctctctgccaactgactccacaaaccctgggaagcagacccaatggggcccttcagatgcaggccggttcacttcccagtgcccagcctctgtgtgagatgtccctggtgacagaacaagaggccatgtgggataaagccagcagaaatcgctgagcatccagcaccagcagggcctccacaggggatttccctcccacctccttctgctccaggtggcctccctgagccacacccctaacgtgccatttccagatggtaaacaacacttgcactgcagtttatctccttggaaatccccacagctcccaccccagaaccgtgcacaaaaaatatcttcaacaggtggatatggatgaattaaggtgcaaaatgagaaccattaaatacatacttgcaagccatttctcttaaaaggtactagagctaagatccttaaagacttgcatccaccattattgcagatgactattcagatgttgtgggcagacatattgttttataaaggtataagaatggactctgatgatggcttgggaatgtattggtccaatatccacttctctctctcttccagggtcagaaatcttggatagagaaaaccttttgcaaacgggaatgtatctttgtaattcctagcatgaaagactctaacaggtaaattgaaatccacgattaagacattatccaaaccagtgcttgtctgccactattctcatgtttgtaagaggcagaaagaggagtccagaagggtggccagaatccattccccatgggagtcactaacaagggagtcactggggctccttgttactccattaacatgcaaatggcttcagaaaagagtttgtgtccaccacccaccctaatgcgaactctcatagccaactgggcccacatcattcctcttagtctcagcaagatcaaggagttgagggctttcaacaggtttccaggatattttccaggcctcttcaatagagtttcataatgtatttagatgaaaaggaatttccatcacaggaaagatctgagcggttgaatgaactagctataactttattaaaggatttggcttgtacacaaaacatccaacaattttattcacctacattaaaatgcatctgttataagctgaacagaggccttgtaaagtcatgtaagtagagattaatttaactaaaatgtctcatctctaagggcaaaagctatgaggctgagtctgggggaaggggaacaatttatccatacattcgtccaatatgaaattcatgcaggtagaataatgacacagaagtacacactcttcaagatcacctgcttcaaatttgtttcacacatgcaatcacagtccctccacatccccaagctgccccttgccccacaccaccctgcagattctcctccctgcttaaaccccagtgattgccccccgaggtaagaaatgccattatgaaacaatgccaacggtcacaaaagtctcccctttgttgcatctacatgtcccttcttatttcaatggcacataggccatcctgggaactctctgtgccagcactgcagtcctccatgaagccagatgcccaggcaatagagggcaaaaagtgcttctgggctcacatacaagcctccttgatgcactccatgcagtccccagcatggattaaaaaaaaaaaaaaactagaatgaaaaaaccaaccgtttaaacccttggaaatgatcccaaagacaaacagcaagtaaaggaatatctttagagaaagccagcaaaaattcagtaagaaaggctagagtctgtgggatttgaaccaagagtttcctccctccctctgcccagctcagcaagatagagactctactccagagtgctgcagccaagaacacagagctccctctccaccagctcccagtcagggggctttcttcctgggaggagcaggatttcagcatttctcatcctgtcccttaccacctgttgctgaggctaagtcctgaatgaatgcagttgagagatagaggctcccttcttccacccgtgccccactcatgtaagcagcaaccacagaaagtgagagtggttataatggattcagacaaaacatactttaaagcaagaaaatgtaactagagatattaagaacattttataatgataaatgggacaatcgatcaggaagttacaacaaatataaacatatatgtacctaaaacagcaccaaaatgcatgaagcaaaactgacataaacaaagggagaagtagacaattcaacatgacagttggagacttcaataccccactttcaataatgcatagatcacctaaacagaagaccaacaagggaatagaaagcttgaacaacatcataaaccaattaggcttaacagataactatagagcacaccacccagtaacaatagaaaacacattcttctcaagtgcatatggaacattctccagcatagaccatgtgttagtccattaaaaagcctcaaaatatctaaaaggatagaaataatacaaactgtcctccaaccacaatgtaataaaattagaaataagaaaccaataggaggaaaaaaattggaaactcataaatatgtgaaaattaatacactaccagataaccactaggttaaagaaaatgtcagaaggttaattagaaaatacttttaggtaaatggaaatgaagacataacaaaccaaaacttaggggatgcaggtaaagtagtacggacagggaaatttatacctgtaaatacctatattaagaaagatatttaataagtaacataactttctaccttaagacactggaaaaagaagagtaaactaaacctaaagcaagtagagggaaggagataatgattaaagtggaattaatggaaaagagaatagaaaagtagagaaattcaatgaaattaaaagctcttctttaaaaacctcaacaaaattcacatatctttagctagagtcataaaagaagagaaagataagactcaaatgactagactcagaaatgaaagaggggacattactaccaaccttatagaaatgagtatgaaagaatactatgacttatatgcaaacaaattagataacttagatgaaatgggaaaattctgagaaatatacaatctgccaaaactgactcaagaaaaaatgtacaatctgaacagatctataaggagtaaagagataggattagtaataaaaaaactgtccaaagaaaagcccaggcccacatggctttttcgatgaattctaaaaaacatttaaggaagagttaataccaattcttcacaaactcttcaagaaaatagcagagaagggaacatttcccaactcatttaatgaggccagtactacccagataccaaactagacaaagatatcacaagatagaaaactatagatcaatatctattatgaacatgggtgcagaaattctgaacaaaatactatcaaaccaaatccagcaacatataaaaataatgatacaccatgaccaagcagggtttatcccaggaatgtaaagttggtttacattagaaaaataaataatgtaatatagcatatcaatatagtagaaacaaaaatcacatgatcttttcaataggcacagcaaaagacttggataaaactcaacactctttataaaaaatcactcggaaaaccaggaatagaagggaacttcctcaacccgataaagaacagctataaagaatccacagttaacatcagacttaatggtgaaagattgctttcctcctaagattaggaacaagataaggatgtcctctctcgctacttctattcaacattttaatggaagtacaggccaaagcaattaggtaagagaaataaagaaagaaaaaatattgagattggaaagagagaagtaaaactctctatttgcagatgacataatcttatacatagaaaaatcctaaggaatccaccaaaaaatattagaactaataaatgagttcagcaagattgtggcatataagatcaatacacaaaaatcaaatgtatttctatacacttgcaatgaactatatggaaatgaaactggcaacataatttatctataattgcatcaaaaagaataataggaggactcacattttctgatttcaaaacttaatacaaagctacagtaataaaaggacaacgatactggcataggatagacatatagacaaatggaacagaattgacagtccagaaataaacccatacacctatggcaaattgatttttggcaagggtgaaaagtactttcaatggcgaaatagtagtcgtctcttcagcaaatggtactggaataactggatagccacatgcaaaagaatagtcttggacccttacctcatgctatctataaaagttaaaatggaccaaacacctaaatgtcaaagctaaaactataaaactcttagaagaaaatgtaagggtaaatcatgacctgggatttggcaaatgattctgagatattacaccaaaaacatggacaacaaaaacaacaaaaaaattgtctttaccaaaattaaacactgtgcttcaagggacgctatcaagaaagtggaaagacaacccacagaatgggagaaaatatttgtgaattatgtctctgataagggacttgtatccagaatacggaaagagatccaataattaaaaaaaaataaataacccaagttttttaaatgggcaaaggaaatgaatagacatctttccaaagaagatacacaaatagtcaataagcacatgaaaaatgctcaatgtccttattcttcagggaaatgcaaatcaaaaccatgatgataaactgcttcacactcagaaggaagactagaatgaaaatgtaagatagtgtgtgggagaggatatggagaaatcagaaccctcagacactgctggtggaaatgtaccatgatacagccaccttggagaacagtttggtggttcttcagaagattaaacatagagtaaccgtatgacccagcaatcccatgcctagtgtatacccaagaaaaatgaaaacattcatccactcaaaaacttgttacataaatattcatagcagcattattcataacagctgaagagtgcgaatagcccaaatgtccattaaatgataaatagataaacaaaatgttcatccattcatacgagaatattattaagccataaaagggagtgaagtaccaacacatgctacaatatggatgaaccttgaaaacatgctaagaagctgatctccaaagaccagatattacaggactgcattcatatgaagtgtctagaacatggaaatccacagagataaaaagtagacttgaggttgcttatggcttggggagtggtgcacaggtagatagatggtggtgagaaggaagataacttaaaatatgccatgccaagtttctttttgaggtgatgaaaatgttcgaaaattaactgtgatgatggttgcacatatctgtcaatactaaaaaccatttaatctctctctctctctctctctctctctctctctatatatatatatatatatatatatatatatatatatatgttttttttttttttttgagacggagtctcactctgtcaaccacgctggagtgcagtgccacgatcccggctcattgcaacctctgcctccggggttcaaacgattctcctgcctcagcctcccaagtagctggaattacagacgtgtgccaccacactcagctaatttttgtgtttatggtggagacggggtttcacaatattgaccaggctggtctcggactcctgacctcaagtgatccacatgccacggcctctcaaagtgttgggattacaggcgtgagccactgctcctggcctgaatcacatacttgaaatgggttgattatgtattacatgaattatatctcaataaaaggaaaaaagagagagagaaagagggagggagtgagggagggaagatggaaggccatcagaaggagggtgggagggagagaatggggaagcgaggagggaaaagaaaaaggaaaacaaaaggaaagacaaggcagggaggaagccccaaggctggccccatgggagcacagaaagccttctggcaagggccctgcacatgtgcattacacacgtgcacgcattcgcacatctagcccagtaaagacatcctctctagtcctcaagccaactccatccccagctctcccaccccatttgctagggtgcacggctgcccacacaggctcctgctgggtccaggaacagacctccctccatgccttccctggattccatctccaccaaggcatcactccaggctactgcagttcttcctaacaaacttttcaagtttttggtgggtccagtccactcaaaacagtggcagccaaaaatgatggagtaacagatgaaatcctaggcacactaggaaaagaagctggcacaaagccagggaacatgttcagagaagactagaaagccagagttcagggagggcgtgagaggttggctgggttttgggagagatgctgtagagctagaagatccctgatgctggggcgggttatggcccaatgggccatctgtccaaggcagaaaaagacatattggtcacttttgaaatagccttttagcattacttgagtggagaaatgttttactaaggaacagaacaattcaacaatatggaaaaatttggctgacacctaagtaagtaattttagaactttgggaggccaaggcaggcggattgcttgagcccaggagttcgagaccagcctgggtaacatggcaaaatgctgtctctactaaaaatataaaaactagctgagcatggtagtgtgtgcctgtggtcccagttactagggaggctgaggtgagaggatcacctgagcttgggggaggtctgggctgcagtgagctatgatagcgccactacactccaacctgaatgacaagagaaagaaaaatctggaaggtcaactctatgttcggagggcatgtctatactttgtcacagaatgtttagtacttgatgtttatactgatgttatcaagacatcaaaaagttgaaatattttccgaaagagcaaccatccaatgtgtctaaaatcgactggcatataaagagatgtgcactgattatctggaaaaggccatcagatggggcatttctgtccctaataacgctggcttactgaagtgttagtaggctcctgtttgggcccaactcacctgttgaggttaattcatttttgctaatgaaggggaaagggggagattgttgtagaaagaccctgctttgcctttgttttcaggtgttgctgtggccagttcaccaaccagcatatcccccctctgccaagtgcaacacccagcaaaaatgaagaggaaagcaaacaggtggagactcagcctgagaaatggtctgttgccaagcacacccagagctacccaacagattcctatggagttcttgaattccagggtggcggatattccaataaagccatggtgagaaaggcattcagacatggtgccactaggatcacagctttcattggcggccagtctcccagccccaaactgcagatacctggtcttcttcatggctgtggctcaatcttcctagatatttcattgaaaaaccaagagatatatctgtgcacatggcttttagccatgaggcttggaaactggacaccactgtaaagaacatctagtgtcccgtaaatccataccaaagctctgaatccacaaaccaggctctggcccaaccctgcaaacacactccattgctccatcttcagtaaaggaagacaaattcatttttctaataactgtggacctgcagcccccttagatgtgttgagagtctttggaaatattttcctctgaggtctgtccacagcttccctgggcctgcgctcagctggcccgagaaggaccaaggtccctcacatttgcatgtaaacagggagtgccctctgcccttccagtgagccctgccagcgtgggggaggcttcagctctgtgatccgttccagctcactctgaattacactcctacatgcccagtcacagactttttgcaatttcattttatttcactggcccaacatcattgttaaaataaaatttagctgtgttccaaatgctgcaatatacagtcttctgaaatggcaccctacatattagcccagacacaaagaagcagtttataggagacaaggcatctgagcattattagcctcctcctcactttgaagaggtcaagttcatgggtgggcccatgatcgcctgacccatttactcaacaacatcctcatccaacttcttgggccactgttctagctaagccagctttggaacctattcctccaacattaggattgccagataaaatacaggacacccagttatatttgaacttcagacatacattggataaattttcagtacaagtatgtcccaaatattgcatgatttattgcatttaataaaaatgttgtactgaaacatttttcattgttcctctaaaattcaaatttaactgggtgtcttggtctgtttggctgctataacaaattgccttaggctggggaatttataaacaacagaaatttattgctcacatttctagagtctgggaggcccaagatcaaggtgccagcagatttggtgcctggcgagggcccatcctctgcttcatagatagcaccttcttgctgtgtcctcacatggcagaagcagagaacaagctctctgagtcctctttttttttttttttttttttttttgagttggagtttcgatcttgttgcccaggctggaatgcaatggctcaatcttggctcactgcaacctccgcctcccaggttcaagtgatcctcctgcctcagcttctgaagtagctgagattacaggtatgcgctaccacacctggctaattttgtattttttttagtagagacggggtttcaacatgttggtcaggctggtctcgaactcctgacctcaagtgatccacctgcctcggcttcccaaagtgctgggattacaggcatgagccaccacgcccagccctgagtcctcttttataaggacactagtcccactcacgagggatccatgctcatgacgtaatcaccttctaacatcccacctcttaacactattgcattgggaatcaggtttccacgtgaattttaggggaatacaaacattcagaccatggtaccaggcatcttttatttgtatttgctaaacctgacaatcctctccaaagttcccttcagtcacttggccacagactcacacagagggctccagggccctgaggaagagacaagccaggcagttcttgcttggacatgagcaatagcctcactcccctttgacacgagaagcaaaaccaagaacagaggctgagtgccacacactctttcacagtatatccgtgtatcctatgacaccaagccagactcactgctccatctcatggtgaaagattggcagctggaactccccaagctcttaatatctgtgcatggaggcctccagaactttgagatgcagcccaagctgaaacaagtctttgggaaaggcctgatcaaggctgctatgaccaccggggcctggatcttcaccgggggtgtcagcacaggtaagagcaggccctttccctcccgataatcaatgtaccacccagaactcactgtggtccccaaagagcttcctaataactaaggacaacaaaacatattgcatcctgatcctatttatgactaaagtgaagtctttattccctagcttgtgttttttactttgatatgactcttaaaaaaaaacagcaaatatagtaatgattgtcataatggtcaacatctctgggtcacccatgacatgcaatattccttgaactgagccctgtacaagcatcatcttcattagacctctcgacaatccttttcctgttataggacaggaaactgaggcacaaagacattaaggaacataccaggcagtatggctctcaattttcactgaaggcagccaaggaatgccaaaaagactccagttatttccagctttaggccttagacatctgtaaaggaaatccctacacagttgctttggtttctgtttttgttttcccgtttctagagttaatgcaagattgctcgttatcatgagctcagactttcagtgtactttgttttaatgataaagatgagtgtgtctcacccctgatctgtagggaatgtagggactcagggcaagtgtccctaaatttcatgaatgatggtgtgctgggaagtaaaagagcctaaaatatgaccaatggctgctcacaggtgttatcagccacgtaggggatgccttgaaagaccactcctccaagtccagaggccgggtttgtgctataggaattgctccatggggcatcgtggagaataaggaagacctggttggaaaggatgtaagtgttttctctgcaaatgttggcagttttttaaaattaatgattgattttgaggtaaccgttgattcagatgcagttgtaagaataataagagagctcccttgcagcctttcccattcctccaatggtaacatcttgcaaaaccataatgcaagatcacaacccggatactgtcattgataaggtcaaggtgcagaatgtttccatcaacacgaggatccctcctgttgccctttcatatacatatacctcactccttcctacccccacctcttccttaacccctggaaacaactaatctgcaccaccccgcatttcaagaaggttctgtaaatggaatcatacagtaatgtaacctttggggattggcttttttttcactccacatagttctctgaacacgcgtccaggttgccatatgtattggtcttcattcctttttactgctggctgacatcccatgatatggaggcaccagtttctttaaccatttgtctgttgaggaacagtttggctgttacaagtaaagtagccataaacattccagtgcaggatttgaggttaacataggttttcatttctctgtgataaatgccaggggtgcaattgctaggttgtcattatctaaaacaattaactttctttctattttaatgtaacaattggcaaaaataaaaccttcaaaaggcagggtagagatgtgagaataagttttagtgcagtcactccacacatatgtattgtgcttgcttcccttgttggtcttaacatccaagtcctgcaggtctgatttgcgctgtgcactttgtcaggtaacaagagtgtaccagaccatgtccaaccctctaagtaagctctctgtgctcaacaactcccacacccacttcatcctggctgacaatggcaccctgggcaagtatggcgccgaggtgaagctgcgaaggctgctggaaaagcacatctccctgcagaagatcaacacaagtaagtgctggcaaaggcacgcagtcctcctgggctgatgccatcacagtggaaacaaggctgagaaggagattgattgcccaaggggattagaagattaaccttgcttcttgttaggtcaacagaaaatgactcacctagatgtcttaccttagccacctaccaaatcacattcactgggctacatggggatgctttgccccaggttcacaagttagcacgaaataaccctcagtgctcgccatggtgatggccttgcccaccctgttgcccagtggttcttgttccctgtaattagttgttattttttaagtgttttaacaggaaaacaatttctcaaagatttagtaggattctttctatttgctgataagtattatgtgattattaaatatctctgtaatgctgggcctttcatgtagactaagatggccaggtggggacatatctggagagggctgcaggagccatctgctcctgaaggggcatcatccttgctggtcctgagggggagctgtcactgtcagacgaaagctgaggtcgaactagagagaaagacgcaaacctcaaccagaagaaacaatgataacaactggttagaattacaataactggtataatctcttggagcatgtttatactccagtaattcttaacgtcaaacaattgttaaatgatctgaaagagcagtttgtttttcccattactggcaagatttttgtgggagaccatctagtcctggcgaatggtcattgggaatcatcatgtatgggactgtgatgctgcagagtgggtagaatggggatggcctactaggaaaagttgtagatttccgagaatcagatctcgaagaatacattggtcgatgactgaatgttttttgttctcacatctctaatttttctggacttgtaagtttttacaacaccccatttcacctggccatgtgacttgtgggcttccctttgtcatccttcgcctagggctctgagcagggcagggacagcaaaggggtgctcagttgtcacttcccacagcacggagcttcgaggactccagcctaagccaagaagaacctgttctactctgttgctcgaaaagaaggtgatttggccaccatattcctaaagattgaaaatatcaatccttgcttgggttggaaatctcaaaggcggagtccaggatatcttagttcatttttccaatatctcctggtcagggctttgcacaaagcagaccctcaatgcatgtctgctgaaatgaacttagctgtaattactctggtggacacagcagagttattcaacatatgtaagagtccctgactgtagaaacacctcatggaagcaaattagaaactctgaaatggctcatttgaaattctccaatcttctcttaaccaatgctggcagatttttatctgaagcccttcagagctgagaccaacgatacttccacttgcctttagttaatatcgatcaactaattcccatcacaactaatggacagctggtgaaataggctcagagtgtgatctgtcatggccagtgtggcataaaattaggaagtaggcaaatgtgcctccactcccatttccttcccattccagaatcccaacttcctggaatcttcctgccacctcttgcttcccagagccatgcctgcaggttctgccaccaaaagttagttggtacccactgtgttcttgaagagtcctattaactgatagagacagagggaggactctgggaacaggtcattaactgatgggccactagtggtccaagtggctgcgtccaagatctgcactttattccagccactgaagacagaaacgtcaacaagaacagtgtacctcatttgtatgctacttaacgtttacaaaattatttgctagccaaacacatattctgatatttttacaactgcaggagttaaaggaagcactgtgattgttcaccttttacaaatggctgtctaaggctcttggtgatttggtgattggcccagtgtcataagggagaagccaggaattgaactgcaatttccctggctggtccagatcccctttcatcatcttattcttcagggacagccatcagggtgggaatttcagaccataggctaggacagccagggggatatttttccagccaggaataccttccaatatttctcagtggtcaccttgaagtagccccaacatcaggtgggtgggttattcaggagtttaaccatatgtgagtcagaaagtttcagactttgaggtcctggttttcccaatgaggccataatatgtgacagaatgcaagaatgataactgggctgggcacagtggcttacacctgtaatcctagcactttgggaggccaaggcaggtggatcacttgagcccaggtgtttgagaccagcctgggcaacatggcaagacttcatctctaccaaaaattagccaggtgtggtggcatgtgcccatagtcccagctactcaggaggctgaggtgggaggattgcctgagctgagagggaggttgaggctgcagtgagccatgatcatgccactgcactccagcttgggggacagagtgtgattctgtctcaaaaaagaaaaaagaaaagaaaagaaaaagaaaattgttatcacatgcctgaattccttccagccagatagaacatcccccaagtcgtaatgtttttactcttccccatacttcaggagttaaaacgactgggtggacagtgcagggcacaggtggtatgggcgaatgtggtttgtgttgcaggactggggcagggcgtgcccctcgtgggtctcgtggtggaggggggccctaacgtggtgtccatcgtcttggaatacctgcaagaagagcctcccatccctgtggtgatttgtgatggcagcggacgtgcctcggacatcctgtcctttgcgcacaagtactgtgaagaaggcgggtaggatttctgacgcgcgaggaagggcgggttcgtaactccctctttgtcgggccaaggagaaaatctaaagtggtctgcttagacattccaaacgtgtttaaatcaggaagatttgctagatctcctctcccatttcctcaggtcagcatccaggggaaccatcagaggcagggtgttcctgatggaattctctctccctcatttccaacttcatttgcccttagaaagtttgcaacaaagctggaatttaggacaagtgagaatacgatgtttgactatggttactttttgtctcctgtgtcaggatatcctcccacagcaaagtctcaaatcaaagacagagatatgtctgactcattcatatatagatttaacttgccttgttttgttctcttgcattttctttgaacagaataataaatgagtccctcagggagcagcttctagttaccattcagaaaacatttaattataataaggcacaatcacatcagctgtttgcaattataatggagtgcatgaagaagaaagaactcgtaagtgtcttgaatttatttccaaacaagctctgtggagagaattatgtttccttttctaattccgcccatgtgtgcatgacagggttattcatattttagtccggccttttctgagagacagtacaaatgcataccaaattggtggctgtgtccacatgacagaagctgaacgagcccacacaggggagggcccctggtgctttcaaactttagcaagtggggcatgacaccacacaacaccctctgaggctcataatattactcagattgatagtcttggggaaaagggccacataccaccctgtcaggcatgtttacaaagttctgttattttatttcccactccttccctcttccgttccatttacaaggaataggtactcttgtcgtgcacataagatggcctcttcaaaattctaattcctacaaatatctcctgtctgattagatacgactttgcatctccgatggcgactgagatttcggagtgtagctccctcctctcgagggtgccagaagggatggggaaaataataaagtcagtatgcaggcaggcaccccacggcaatgccataacttctggaaatcagccgggcacagtggctcacacctgtaatcccagcactttggggggctgagacaggcagatcacctgaggtcaggagtttgagaccggcctggccaacatggtgaaaccccatctctactaaaaataccaaaacaattagccaggcatggtggcgtgcacctgtaatcccagccacttgggaggctgagataggagaatcgcttgaacctgggaggtggagtttgcagtgacccaagatagcgccattgcactccagcctgggcgacaagagcgaaactccatctcaaaaaaaaaacaaaaagaaaaaagaaaaagaaaagaaaaaaaagaaatcaacagcacttgctttgaaactgtttagtgctcaggatcattttattacgtgtcagtctctgtggtcattttgtaacaacaccccatatctccttcttgttttcaacttggctttaattcagtcttttcacattttcaggtcactgtgttcagaatgggttctgagggccagcaggacatcgagatggcaattttaactgccctgctgaaaggtgagctctcaggaaatggtgactcctgtccctctgatgttggcctagccggcaatccttccctcccggcctcccatggactatgtctgctggtgctagaccctgagccagccaggccacttgagcagtctcagcatgaagccacggcagaatgacaaggctcgctgtttctgtggggcagaggtctgtgggtgctcctggaccatcatgggctgaggtcagaaccgtttctatttgtaactggttcattgagggcttcagctcctagagtgtaaacatcagatgggttcctttgcaatcactgcattccgcagtgttctgtccaatttccccgtcttggttctaatgacaggcttcaggccagcgttcatggccgggcggggagggtctgctctgggatgcacacttcctccctgcctctcagttagcctggtgccatgagggggcagggaggacagagagaggggaagggtcactgtcaggctggctgcctggcagtcccagggttccagccttcctggagatcatctccagggtccctgagtcactgggttcctgttctgtccctcccaaggagaccatgcacagctggcatgggaagaggctgcctccaccttcctccagggaagctctttcagctcggagcctttgtggtcattcagggcaagagcaaagccagcaatgcttagttctaggccagcagcccaagggaagcctgtgctcaccacccagcacctgccaaaccctggcggtccaggcgtggagtgaaaaatcattccggtttcttgcctttccaggaacaaacgtatctgctccagatcagctgagcttggcactggcttggaaccgcgtggacatagcacgaagccagatctttgtctttgggccccactggccggtgaaactgttttttttcgattcatatcattgatcttgactttgtacaagtgacctattagtatgttctcccttgtgacatggaattcaggaaattatgtggggtttctgatgatatgatatgtaatctattaggctcattagaagatgtcactgtttaacttcaaagaaccaacaagaagtaattccacattcaaaccagtactcctgaagaaattaatcaccaaatattttatcgttgctgatgaaagtgggtttttacctttttaaagaaaaagaagaagaaataaaatagcttattaaaatttaatgcaatgcttccatccagggcaatgatttttcaaactatgttccatgaaaccctggaggcctagagaactctgtgtgtgtgtgtgtttatgtgtgtgtgtctatgtgtgtgtctgtatgtgtgtatagggtgtctgtgtgcatgtgatatgtggtgtgcctgtatgtggtatgattttgtgtaggtgagtaatgtgtgtggccatgggtggtatagtgtgtatgtgggtgtcattgggagggtattgtgtgtgtgtgatatgggatgagcagtgtgtgtggagtgttgaggagtactaatgtgtgtgtgtgacatggggatgagcgtgtgtgtgtgtgaacacacataagtctgcatgataaaggactccaagcctcctacttcttcttcagtcaaagcagcttctttgatccattttatagattaggagtcaggataaatttgtgtttgcaaaaagggctctgctgcttatgaaaggtagtaggaatatctagagagtttatgttggttttaaaaaccacatttcttggccagatgtggtggctcacacctgtaattccagcactttgggaggccgatttgggaggattgcttgaggccaggagttcaagaccaacctggtcaacatagtgagacaccatctctacaaaaaataaaaaaaattagccaggcatgggagtgcatgcctatagtcccagctactttggaggctgaggcaggaggattgcttgagcctaggaatctgaggttacagttagctgtgactgcaccactacactacagcctgggtgagagaatgagatcccatctctaaaacataaaacaaaaaacaatgcaaaaccatttctcaaaacatccctggcatattgctgcacaaatgcattttacttaactgcctctgtgtttaggtctcccaaagcatttaattgcctcccaaagcatttaactgcctctgtgtttaggtctcctggaagttgcttccacacattgccataacacgttttatcactctttattgattgatcatgtgtagacggatccatcaattctccacttggtaatagaaggaggtggattgctcactctgcttccactgcccctgttcctcctggatttgatagttgcctgtttaattctattttttctttttttgaaatggagtctcactctgttgcccaggctagagtgcagtggtgttatctcagctcactacagcctctgcatcccggattcaagcgattctcctgcctcagcctcccaagtagctgggactacaggcacccaccacacccagctaaattttttttgcatttttagtggacacagggtttcaccatgtcggccaggctggtctcaaactcctgacctcaagtgacccacccgccttggcctcccaaagtgctgggattacaggcatgagtcactgcacccagccctgcttaattcttatattggtcacctttatgacggtaaagagtacgtggaaccacctacttgttctgtccgcttcagactcccattttgttaaatgaggaaattcactccatactcctccttcctctcctgacaagtttcatcttcctaattcaatcagccccacttttacaaggtgcttgacatgatgaacatgtacatatccttctttaatcattgaggtcctgcttacatcttactctttaatcatcattcagtttttgtacttagtctctatgttgattctaaaaaaatggagaaaccagcagctttgacattgttgtgattacatggagattgttcactgctgaaccgcaaagtaggattgaagtcaaggagaagggaaggtagtcctgggtcatttatctggctcacacaaaggaaaatatgacaggcatcaaggtttccatcattcaccaactatttaaaattaggtgacactttaatttccttcatatttggaccatgacttatttgaatagatatttgcttttctccacatttctaattgattctctttttttcttccaaacatttgccttgatgtcattgctgtatctattcttttttttttttaagtatttttattgtatctttagtttggttccaaacaaatagatgtaaagtttggtacctgcctatgtacacttgccactgctaatgttgaggcttatactagtccgttttcacactgctataaagaatagcagtcttctgagactgtgtaatttgtaaaggaggtttaattgactcacatctccaaatggctggggagaccccaggacacttacaatcatggcggaggacaaaggagaagcaaaggcacatcttacacggcagcccatgagagagagaaaagagcacaaggggctgccaaacatttttaaaaccatcaattctcataagaactctttcactatcatgagaacagcgtgggggaaactgccctcatgatccaatcacttcacatcaggccccactcttgacacctggggattacaactggagatgagatttgggtgggacacagagccaaaccatatcaaggctcttgtcagcaacgtggatatatcaagcatggctgcagcaaaggctaccctgtggggagctagggcaaaattattgcactctttccaagatgaagccatacagatattaccttaaaaatgccattttgtacttttatttgcatatacatagtttatatttaatatatactttgtactttaagttcaggggtacaagtgcaggtttgttatgtaggtaaacttgtgtcatgggggtttgttgtacagattatttcaccacccagttattaagcctagtacctgctagttgtttttcctgaccctctccctcctcccactctcctccctccaaaaggccccagtgtctgttattcccctctatgtgtccatgtgttctcatcatttagctcccacttatgagaatatgcagcatttggttttctgtttctgccttagtttgctaaggataatggcctccatctccatccatgtccctgcgaaggacataatcttgttcttttttatggctgcagccatatctattctcttaattgttactgtcccatttcttcttgaagaatctttcaaagccccatgagttcctacccccatcttccctggatgctctcaatgcctactgtacagttgtctacatcagacatcccttcgttgcactctgagactggccattgcctcctagaccccatgtcttcctccctttcagattcctttttcattttgctggagtacatcttcaagtaacttttacataaaagcatgtgggagaattactgtctgagtctgtgttgtgtttctgtaacagaataccacagatggggtaactgataaagaaaggagatttatttcttacagttctagaaactggaaagtccaagatcaaggggctggtatcttgtcagggccttcttgctacatcatcccatggtgggaggtgaaagggtaagagagcgagagacagcgagagagggctgaactcttaaaacaaatctctcaagatcatgaaccctctccctctataaaagcattaatccattcatgagagcagaatttcataacctaaacaattttaaaggtcccatctctcagcactgttgcactggggattcagtttccaacacaagaactttgggggacactttcaaaccacagcaattatcattctgtgtctttacatgtctgaaaaaagtctgcctcacatgaggctcaagattgtcctatgattttcattcaattatagatgaaccattgttttctctctgctctttgctttttcagtgcttgaaaatttcacaaggatgtatcttctatttcaagcaaatgaaaatagaagtgtatagagaatacaaactcaagcagccatatcttcacacatgtagacatttaattcttctggctttcaaaggtccctttatgctgaagacctgaatcagctctgtgaaattttcttctatctcttctttgagtatttctttctttattatctctttcccttcatctggattttctattagtcaagcaactgctggtccccttctcccagactgaccgtccattttcggttttttatttctctatcattttgctgtatgtttttggaaatctcaactttttctttagcttttatacaatttttaaaggtttaggcactcatgctttttatatttaagaaagtgtttttgttccttaacaattttattttcttattagcctattttcatctcacagatgcaatatctaaggatatgaattagattttttgaagttatcttctgttccctagattatctctattttctccctggtcagctgttctttttgttcattttgggtttttctgttatgctgttgattttctcaaatgctctagatccttggctgtccatcacactacagaatgagggatagaactgcttaattggtatggaaacccattttgccaacaggtttttctcctccctgggaggactgcccaggaattccctgcttaggaaggagagtatcgcctgaacctcctgctttgctgagtgccgactggagagggctgatgggctctgggcctccctattctttagcagacatcctcccagtttttactgggagtgaagcccaggaatgcagttgcttgctctgcacccaccacagtggcagcctggagaccgggaggggatgtgtggcctcctgctctgtagaccatcttccggtcaccatgccttctgcccaccacatgccctcttctttgtatcttggaaaatctggtctcacctcaagagcaacctccacattacacattttgggctttggcttcctctccatagttttaactggtccttcaatgcttccagaaatttgttaaaaactctctggcccgcctcttctccctgaaatagatttttctttttcatactcctctgctgtcatttaaatagtatctggggagggagggaagacaggaaacacatgctcaggctgtaacctggagccaaaagtccttctctgtctccctacagtgggatataaggtctccaaaatcttcttttaatagttgaagcactcaagaaaggatgtgcctgtgaatctatagtctatctagaattcttcatatagtagaaaacttgtggtagggaggacataagaattccaacacagtaaatcaatcttaggtctgatttgctatatattactagacaaaattcttctatctatattttctgttattgaatgcaaaaaataaaagctgcatgagagtatgatgtggttatcagaagctaggatgtgagggattgggagattttggtttaaaagtacaaagtctcagttaagaagaataaattctggagacctattgtacaacatagtgactataattaataataatgtatagtgcacttgaaaattgctaaaagagtagattttaaatgttctcatcacaaaaatgataagtatgtgaggtgatggatatgttaattagcttcatcgttccacaatgtatacatatatttaagcatcatgtataccataaatatatacaatttgtcatttgctaattaaaataattaattaaagtaaaagctttgcaaaaaaaattcttcttaaaacatgcttttaaacataacgaagaggccaggcacagtggctcactcctgtaattccagcactttggaaggctgaggcgggtggatcacctgaggtcaggagtttgagacaagcctggccaacatggtgaaaccccgtctctactaaaaatacaaaaattacccgggtgtgatgttgcatgcctgtaatcccagctacttaggaggctgaggcaggagaattgcttgaacctgggagccggaggttgcagtgagctgagatcatgccactgcactccagcctgggtgacagaacaaaactccgtctcaaaaaacaaacaaataaacaaacaaacaaaaaacataatgaagagagagaaaaagagagacgtttgatatatacaggtaacaaaaggcaatttatttatttatattgaatcataaaaactttggactaacaatttttgaaggaaaatcatcaccaacattcatctcaagagcttttttatcttgcaaaatggacactctatgcccatcaaacaataattccccatcctgccctctcctgtgactggcaaccaccattctactttctgttgccatgaatatgactactgttagtacctcctataagtggagtcatgtaatatttgtccttttgtgactggcttatttcactcagaacaatgtctcaaggttcatccgtgttgtagcatttgtcagaatttccttccttttaaggctgaataatattccattatatggatagaccacattttgcttatccaagcatccatcagtggacacttgggttgctcccatgttttagaataatgctgctatgaatgtaggtgtacaaatacttctttgagacttgctttcagttcttttgggtatgccaagaagtgaaaccattgatcacacggtaatcctatttttaattttttgaagaatcaccaaactcctcccacagcagttgcaccattttacatttccacccacagtgcacagggttccagtttgtcctcattttcacaaacatttgtcattttctgttgtttagataatagccatcttggctgggcacagtggcttacatgcctgtaatcccagcactttgggaggccaaggcaggtggatcacctgaggtcaggaattggagaccagcctggccaacatggcgaaaccccgtctctactaaaaatacagaaaaaaaaaaaaaaatgagccgggagtggtggcacacatctgtagtcccagctactgaggaggctgaggtaggagaatcacttgaacctgggaggcggaggttgcagtgagccaacatcgtgccactgcactccagcctgggcaacaagagcaaaactccatctcaaataaaaggaaaaaaaaagataatagccatcttaatgggtgtgagataatatctcagatggttttgatttgtatttccctaatgattagtgatattgagcgtttttgtgtgtgtttattggccatttgtgtatctgctttgtagaaatgtctattcaagtctcttgcctatttttgaatcaggttgggttttcttgttgttgaattttaggagttctctatatattctggctatgaaccccttatcatatacatgatgtacaaatatattctcctattctgtggctacctttactctgttaatggtattttttgctgcacaaaacttttaaattttcataaagtccatcggatttgttattaataatttttccgtttgtgcctgtgcctttggtgtcatattcaagaattgaattcccaaatccaatatagtgatatttttgccctatgttttcttctaagcattttagtttaattaattaattagtttttgagattgagtttcactcttgtcacccaggctggagtgcaacggcacgatctcagctcactgcaacctcttcctcctgggttcaaggaattctcctgcctcagcctcctaagtagctgggattacaggcacccaccaccatgtccagctaattattgtatttttagtagagatgggattttaccatgttggccaggctggtctcaaattcctggcctcaggtgatccatctgcctcggcctcccaacgtgctgggattacagacgtgaactaccgtgcccagcagcattttatattagtagttttcgattttatgttcaggtatttgattcattttgagttaatatttgtatatggtgtaaggtaagggtccaactccagtcttttgcatgtggatatccagttttcccagcaccatttgttggatgcggtgtcactctgtcactcaggaccataacggttttatctgcatgaggagtcagccaagacactttttcatccatatttgtatgttgaccaggaactatataaatgcacacctcccctgacataagctctgcctcagccctacttaagggttttaagcaggagagttacttgcttccatttttatatttaaaggtcactctggagttactgtggaaaatgcactgggtgggtgccatggcaggtgtgcagagtcctattaataggcctttgaaataattcaggccttggactagagcagaggcaaagaagaaggcaagaatcagaattaagcaaaatttagcattaaacatggctgcacataggggtagatgaatcattgagggcactggagggactgagatgtcacaatgctccccagttctctggtttgcacaacttgcaagctgtggtaacatttccctgagataagggaccctggaagaggactgggtcggagggtaggtcctgagagtggtttgggacataaggagctgcatgtctttgagacatgcaagcaggatgctgagcaggcaacaggagctctggggagagaggtgggccgcagccagaaaggagaagttgtatgccaatcagtggtgactggtggtgtgggggtcaatgaggtcgtcaaggaagagagtagagtggaaaggtagaaggctgaggacagagcccagaggaaccttgacatttaaagctgcactgagaagtagtggccagacagggaagaggaaagctgggagcttgtgatgcccaagaagccaagggaagagactctaggaggaagcaggcagtggagtcagatgtgctgagaacccagcatgaaatgcccatgaggcaggcaccagcacagttctcagcaactaaacccacagcccaggacagatggaagaagcagcagggtgcgtgcaggagagataggaagagaggaaatggaggctcctcaggtaggcaatccaccaggagcgtttggtaagaggagcgggtgggtctggcaagagaggacgccagctggagggtccggttgtttaggtgctggctctgtgtctgcaccaggacacactcccacattctccaccagaccaggagacaaggccacggggccaggcctacttctgctgtccctcctgttctctggagtagagcacacactccccttgatgaatgagtctgtcaccgcattgcatgcatttcagtgacatgcggagagcttctttacccgccgataagctccagtttacgtttacatccaggcaggcatcctcagttctatccattgtcttgtacccccttcacaatcactttttcccatcattaaacaactatggacacatgtctttggtgcctttgaactctcctttcagcatcctttcctccatgcaaaagcacacatggatcaaaatgtcagccactttaagtatgcaaagtcgctgcatcaagtcaagtgtgtgtttgtgcacacgagtaacagtggttcccagtatcagagccttcttcagacagccaggcctgcgacgactgagtatgtaggtgtatgggatggagtccgtgtgcacctgtacatatgtgtgggcatatgtgtgcactgtgtgggtgtgcacatgtacattgtgtgcatgtgtggtgtgcatgtgtgcacatacagaggtgggagggtcaatgagctggtctggggacaagaaagagccttagtaccatttcccaactctgattgctgtggactgcagcccctgggaagcctggcacccccgacggacagcaaagccacggagaaggagaagaagccacccatggccaccaccaagggaggaagaggaaaagggaaaggcaagaagaaagggaaagtgaaagaggaagtggaggaagaaactgacccccggaagatagagctgctgaactgggtatgtggaaggtcacagagatcacgagcttggcatcacccttccccaggggaagggatggttcttgtccttgcttcagtcccacccagggccctgatcccaggagggacgggtaaaggcttgactgggtagtgtcagcatttcaaactacaacagcacattcgctgcaatgagcctgtcggttgtccaaaacaccaaacgttcctgctttggggggaatgatgccacccacagaggggccctgagtcatcctgttcagcaatggttctgtacctggcagacatgccaatgcttgatgcatgaatatacagcagacaaatcagttgtcaccaaataaatgcaattcatgaaaaagcccttttttgacagacagagcccatgattgggtgtgtggggtaacagcagtttaggtggggaggctggagccacacatcgcatggcagttcttggtcttgctgccaccaggacacaggcaagacaggggaccaggcctctgtggtgacgtgtgcctgcccttatcacagtcactcacccacacggcaccctggtcatgctgcctgcccatgcagctcctcctggcacaacttctcagtcaaggaaacaaatggtggagactgggcaggccaatgccaggagggctgagattttgaatcctcttcaatctatttttaaaaggaaacaataatttacagacatggatggaacatgtagaggccaaactgagaagaaaggagaggggagatggggagtgtttacccaagataaagagcaaagagtaccatgctggagtgctctggaatctggcgttcggaataccctttcctctgtgtttccagtcgcccccctcccctgtgtctctgagaggccactcacaggctcccggcccttggtccctgcaggtgaatgctttggagcaagcgatgctagatgctttagtcttagatcgtgtcgactttgtgaagctcctgattgaaaacggagtgaacatgcaacactttctgaccattccgaggctggaggagctttataacacagtgagtgctctagaaaaagggaaggaagcgggaggcagccacctaaatgtgtttgtcactggtgcatattgtgcataaatgtgctcatctgacctccttcagctgggaggtccgtacttaatggcaggcggctacttctcacctgctgctggccacagcctgtgttcatattctcaccacctcctgccatgcctcgccagtcactcctttctcaggcagtattaactcttgtcccgcatttaagggtggtgtgtgagtacttgttgctacaaagagggaatctagctccccaagccattagcagagtgaaatgtcaccaagggtgagaagtcaattgttccttgggaccctcacatttgatgaggctttggggtaaaacatagagctaagtttcacacccaggagctctgctggaagggtttgaatgaaattcccttggcttatattattacaatataagttttgagaatttacatttccttccctattgtaagattttaagtagcagaaatgatcctcagcagctgcttgctaaaacttggtgaatttttttttgtttgttctgagacagagtctctcttgttgcccaggctggggtgcagtgacatgatctcagctcactgcagcctcaacctcctaggctcaagccatcctccgatcccagcctcctgagtatctgggactacaggtgcacaccaccacacccagctaatttttaaaaattttgtagagacagggtttcgacatgttgcccaggttggtctcaaactcctagcctcaagtgatccacctcccttggcctcccaaagtgctgggataataggctcaaatatactaatttgagccactgattctggccaacttgatgaattattaacactatattgtgcaccttaagatactcttttaaaaaaatgcaacagaaagtatttcacaacttttgaaatgtgttggatactttctaaccatgaccagctctgttttgtaaaagaaaaaggctggtgtgggttacactccagctctcacaattcattaattatatagagtagggcaggattttgctcgaagagttcaagaaaaaaacttatttatttatttatttatttattcattcttagacgaggtctcactttatcacctaggctggagtatagtggtgcaatcttagctcactgcagctgcctccccggttcaagtgatcctccaacctcagcctccctagtagctaggattacaggtgcccaccaccacgcccagctaatttttgtatttttagtagagatggggtttcaccatgttggccaggctggcctcaaactactgacctcaagtgatctgcctgccttggcctcccaaagtgctgggactacaggcgtgagccaccgcgcctggccaagaaaaacatatttaacacacatgaatgcttctctttcagagactgggtccaccaaacacacttcatctgctggtgagggatgtgaaaaaggtcagtctactgttttacaattcttacctgttggcatctttcacaaaatcatttcttaagagcaagttttaaattttcaaaatgtattattattccaggcacaggagataatgaattccttctttcgtaaagagtctatttaaaactaagaaagcaaaggataatcttttttaagttgcatgttcatccaaatccatgatagggacactgtcagtgacagccggattataggttgacgccagcgccaggccagggcggccactgggtggggttggggaagggggtggcctggctgctgacctgagccccgctgtctgtccatgcagcctctcgttctgtccctcctttgagatctctcacccactgcctgtggctctttccagaagcaccggcaggaggttcctcaagtcattctgtgtcctgttgattgcagctgctgttcttggccctttctgccaccttgttatcaagggatagatgctttccccagcctgaatattgtttaatcccccacccacccacctgttacatgaactcccaagtgggggccaggacagccacttaccccctagacgtgtgatgaagtccacactgcgaacgcattctcacagggcctgagaccagacttcttttacagagcaaccttccgcctgattaccacatcagcctcatagacatcgggctcgtgctggagtacctcatgggaggagcctaccgctgcaactacactcggaaaaactttcggaccctttacaacaacttgtttggaccaaagagggtagaactcagtgcctgtgtagtgttctgtggttcgcgagtaccatgtggttcctcgcttgcttttcaacaacttggccggttcagagccaagcccttcgccctgtccccagcacagctgtcctgcctcctacagtgctctcaggccagagccacggcattctccagctcccctgagcacgggccgccccgcccatccattgcatttgccctccttttctatccacagcagacttcctcctgggctccggggctactgtctgcctgctccagcctattctactatcccaccactgtacctgccataatcttccaaagcaagggacatgcctgcattccctgcttcaagcctcccagagctcctcactgcctggagaatcgtatccaaactcattatcacagcagccaaggccctccaccagctggccctcacccacatgggagaccacatacctgcaccaaaatcaaatcctgtgatcaaatcaaagacgtgtacctgccacgtctttccccactatcagtgcctttcccacccttatcaaaagtccaactcaaatgtctgatctttcatgatgccctcctctcacacccaccttacagccccacagctctctacatgtctattagggaacttctcggtttctacctggaataagggccacgcgtctgctgagctttcttctcaattaacttctgctgacagaagaagagtttctatattaaagcacttcttttccttggatattatcattaattgttaatgatacaaagtgctttttaatccattcgtatgtccactatcaacaatactgctaatgtactactaacattagttatctaagtaaattgattttttttcttcctctttcaccatgcagcctaaagctcttaaacttctgggaatggaagtaagtagaacttgttttcaacagttttataatatcctggtcaaatatacatagcccttttaagttctgtatttgcgaatatacgatactactcaccaaaatttacctagatgtcttagtcaaattatataaaaggaccatatatacattttctttaatggggataaaagctgcacaatccatttctagaactaacaaaaccacagtttcaaaagcaaagattaagcaaacaaaaaaactagagaggaacaccacttacgtatgcaaaaaccataagtaaaaaaccaaaaataacaccaaaaagaattcaatagactattttcatagtcctaaatcaaagtagagtcctccaagaatgcaaatacaatgcagtgttagtctttaatatattgcatcatatctatgaccatctctcagcaggtgctaatgaagaatttgaaacacatgtaaaacatatgccttactttgttaaaaaatatatagttttctcaaaatagaatgataaaatactttcttggaatgattaaaatacacgtatatcttagagcaagggaaacgtatgatgagcagtgcatccctgaagtcatgtccatgagaatcaagaacaagacaagcatgcccaatatcattggcgtcatctactgttttataattcttacctattggcatctttcactagtccccaaaagtgttctggaaattgaaccacaaggaaaaataaatgctaaaaaaagaatacccaagaaagggagaaattattatcagcaaaaaaatttggggggagttagaaaatccaggaaaatcaactaaagttccctcacaataggacaaaagtaccagaaattacctttactagcaaccgtaagaacaatgtcccagacctaaaaatatttaaatgaatggaagaaatgccatattgtggaatattaggattgactcttggaaacattctttttaaataaatttatgagctaaacagcatcccgattcttcatggattcagtgtagacggctttcattctgtgttgacaattaagactgtcctttaacacggtgctcctggaagggttatgagctttctgtgatctcctgttctctcaaactctccaggtcagggtttatttattccatgaaggtttggtggactcacctgtaaaatttccgggtccagtcctatttcttagaagtgtgcatttcataatactacttcataatagccattataaatataagtacatttcaggctttttattttctagagtcaactttggtcatttatagtttcctaaaatgacttatttcatctagactttcaagttccctggaataaacttttacatagtattctagtttttttcagtctcctcagtatcttcagttgtgtctcatttcttgtgccaattttttttttttttttttttttgagtaggagtctcactctgtcacccaggctggagtgcaatggtgcaatctcggctcactgcaaccttagcctcccaggttcaagcaattctcctgtctcagcctcccaagtagctgggactgcaggtgcatgccaccataccaggctaatttttgcatttttagtagagatggggcttcaccatattggtcaggctggtctcaaacttctgatctcagattctcaggtgatccacccatcttggcctcccaaagtgctggaattacaggcacgagccaccacgcccagcctcttgtgccatttttaaacaaaatttatatctcctattttcttaaactttctttcctacatattttactggtatttttgctttatcaagcaacttcctttttctgtttctattttattaatgtctgcttttatttgtatttgtttcttccatatactttccctactgttattgcattgttcgtgctaactcagtttgaaaggaaaattcactcattttccatcttcactgtattcctataaatgcattaaaggtataaattgttctgagcattgtttcatggtattccacaggtttggataagtagaaccttcattgtcgttttttctaaggcatttattatttccttttcaatccaagagttatttagaagtgtatttcaaatttcccagatacagacttttgttgttgtcatactactgttattgatttcaaagtttattccttgtatagaaatatcctgtaattttttttcaaattcattgctaagtaaggtgtgttacttactcaactatggtaatatgtcaatttttccttacactcccagttcagatcctttgttattttattggtttttttcccttttcctcattgatttgtgacaggcctttgcattttaggaaaattaactctttgtttctcatattctctctctggcagtttttaaagagaatttacatgcaattaatattttaataatattagatgttattgaaaggtaggcttaaaaggacttctgttttataacatttcattagtcattagttaatttttattttatcttatatattcttgaaaatctatgtttatctaaacatttctacgatgttcatttttaacctgtgtagatgaacctttcccatatcactgcgactgtagcttcactgtgacaaaattagaaaattagaacaaagatatttaaattggagtcaagatactatattttccattaaaatgttatcacagctcattatgatattataaaaattgggtcagtcgtggccgggcgtggtggctcatggctacaatcccagcactttgggaggccgaggcgggaggaccacgaggtcaggagatcgagaccatcctggctaacacggtgaaaccccgtctctactaaacatacaaaaaattagccgggcgtggtggcgggcacctgtagtcccagctactccagaggtgaggcaggagaatggcatgaacccgggaggcagagcttgcagtgagccgagatggtgccactgcactccagcctgggcgacacagtgagactccgtctcaaaaacaaaacaaaacaaaacaaattgggtcagtagtgaacaacctgagataggaattggagagccaggatacctcctataactccccatgctccagaccactccaactctgtgaatgtggctgagttattcagactgagccacagcttcctaatctgagggaatggaaggaattcacaacctctcagagtccttgtaagaataaaagaagataactgatgggaacgctgtttgcaaaagaacaaacatctgtttctgttattccattgaatactaaagtattagcctggagtagtctgagacccacatatttcatgccaattttcccaatcacgatctgcctttcttatgaatcctgatccattcacagaacagttctcataacccctttaggaaatgggaaagattggccttcctttttgcaccatatggggaaaaggacagtgctcactaaaagaggaatgtttgctttcttaaaacactggagggaaacctaaaacattttctctagccccttttgcatgtttcctgttaatttctggttcagctacgtctggcaaacgagtgttatttttgctacatttgaagacctccctgaggaaataaactgtagaccttccctcttccatgatgttatttgtgtttagttttgggggaggttttgcttgtttgttttagttttgcagcgtcgcctcagttaaaggcttctaagtaaaactgctgacccaggggtgcaagttatccaaacagtatgccttctcagttcatttggttttagatagtttacttatcataataaacgtgtgcatcttttcaaaagaattcatatgcggagtggaaatgtaagatgtacttcagaagtctctttattacctctgacagaaagggttccctttctccaggagttctggaactctttgttgcatacttttatggcaaaaccatgaaatccatgtttctcccctcaggatgatgagcctccagctaaagggaagaaaaagaaaaagaagaaaaaggaggaagagatcgacattgatgtggacgaccctgccgtgagtcggttccagtatcccttccacgagctgatggtgtgggcagtgctgatgaaacgccagaaaatggcagtgttcctctggcagcgaggggaagagagcatggccaaggccctggtggcctgcaagctctacaaggccatggcccacgagtcctccgagagtgatctggtggatgacatctcccaggacttggataacaattccaagttagtgtctagcggggatttaaaggccaggagagatgaccatcctgagtacttgtctctgcagggaggggtggccaatgtacttctcacttaaggacaatggtggttaaagcttgttcacaaatcacttcgtctgtcatgtcagcatttttctttctgtctctcagaggtgtttttggactgtcgttgtttttgtgtactgccttctctttgcatcaaaattgaaacacaatttttttcctttccttgaaacacaattttaatgcaaagatggtgaaattaatttccatagggaaacacacactaacaaggaatacaacattaatgagcctgtgccctggactgtgacctggactgtgaccttcacaggtgtttctgattttgctccatgcttaggtgggacaggatggctagagggggctggagttgggcgtgcttcccctgggtcagtcaggctctgatcaaaccagcaggtgaggctctggtaaaattggttctcctggccgggcacggtggctcatgcctgtaatcccagcactttgggaggccgaggtgggcggatcacaaggtcaggagatcgagaccatcctggctaacatggtgaaaccccgtctctactaaaatatattttagcccggcgtagtggcgggcgcctgtagtcccagctactcgggaggctgaggcaggagaaaggcgtggacccaggaagtggagcttgcagtgagccgagattgccccactgcactccagcctgggtgatagagtgagactccatctcaaaaaaaaaaaaagttgaaggaacttggaacgtttatggttattgccaaatatttgaatctggatcatgtggggaaggcagtaaactttatgctcaaaattcagcttgtgccaccttctccatgccccccaacttctatcactgtccccatcagtcattagacgccctctggcctgggccctatgacaactatgcctcatccctgtcatagcactgagaatgttggcttctctgtaatcactgtgatggtgaagtgttacacgggcagagaaaggcatacatccgaaatgtccagctggtgacagtccacaggtgggacatgccggcaccaccagcacccagatcaactaagaacctagccggcacccaccagccctcctgtgactcctttcagtgtccacctcccgccaccaccaccaccagcagccccgctactgtggcctccaactccacaggtgctgcatttgaagtcacttttgctgtcttttctatctgcctccctgatctgtgcacaacttgagggaagggactttgtcttctcgtctctatgtccctggggtctgaggggcagatgtggtctcaacctacagctccatttgcagcagtagcagtcagcccacctcctgactgagctcccagccactgtccctggccttccccctttggggacacatccctggagcttcttgcttgcagagaacctcagagcccctccagtgaaggatactgtgtcccgtggctccataagtccttggtggatatgcctgtctaagaaacagcttgcggccactgtggcttcaccctggtcccttctctttccccccagagacttcggccagcttgctttggagttattagaccagtcctataagcatgacgagcagatcgctatgaaactcctgacctacgagctgaaaaactggagcaactcgacctgcctcaaactggccgtggcagccaaacaccgggacttcattgctcacacctgcagccagatgctgctgaccgatatgtggatgggaagactgcggatgcggaagaaccccggcctgaaggtgcgtgcaacgtgctgcgaggcgggccagggtgacagtgacaagtgactctctgccaggctgaactgagcactttctgtggcttatttcatttattccttctagcaaccccctgagggagacgccatgacaatcattgtcttatagatgaggaatctgaagctttgagatgaagtgacatgcctaggatcttagctggtcagcatgggatcagaacctacactcaggtgctctaactccagagccccacctgaccagcccaccaggctgcacaaacccctgccacagtcagagtctcctaatggagccccccataactcagtatgcacacgcaccctggttgggtcgtctacccaccattaaaggagggactggaactctgtttctagattcccttataactctgaaattgtgtattattttaactagtgatgttttcatgacatgggagaaaattacaagaaaataggaagctacgaaagggtttgaaaaagatatagtgggggaaaaattatattgcaatcaaaccctagctcttgggtttactgctgttaactactaggttatcttgagaagagattctaatctgcagataacctagcaatctaatggcagtattatatctattttagagctctccatgaggataaagaaaagactatacgagttacactgtgtagtatggttctggcaaatagagggcactttgtttcttagaaatgtgaatgttatgcttaactgtctaattctatataatatgctaagctgatgttatacataacttaggatattaataaacagttttcagaattccaagaataaagagctctttaaggttttcaggaaactaaagtagatcgcctacatggggatgaacatcaaattggcatcagacttttcatcaacaacactgaaacccagaaggcagcactggagtaaggccttcacggttctgaagggaaggcatttggagcctggaatattttctacccaggccaactattcaaaaagcatgagaaaagaatatctgtttaagacaggcaaagactcaaactatacaccttcaacctcccatgcagaagaattagtttagcaggtagtccaagcaaaaaaaaaaaaaaaaaaaggggaagcatgttttctatctatgagcctgggcatccgggcatccttttgttgtctaggccgagcccatgttagtccttcttttctgagtcacattagccttgcaactcttagttcacataatctcatttatatcaaagttatttctatataaaatacttttggcctacttcactagaggtattatattttatttatattattctattttaatttaaagatttgccttcctcgaaatttcatgtaaggacttttattttattttattttattttatttttgagacagggtcttgctctgtcacccaggctggagtgcagtggcgcgatctcgcctcactgcaagctccgcctcctgggttcaagtgattcttgtgcctcagcctcccaagtagctggtattacagacgtgcaccaccatgcccagttaatttttgtattttagtagagatggggtttcaccatgttggccaggctggtctcaaactcctggcctcatatgagccaccaaccttggcctcccaaaagtgctgggattacaggtgtgagctaccatgccagccaagacttttctttttaaagttaggatcaccaacagtgctgtttgccattcatctaaaaaatttagtgtatgttcttaaattgttttactgcctgcaattctactaatttaccaagcacatgtcacagaacgtcagaccagggataacattccagggctcctaggttattgaataatgttgaaggtcataatttaaaaattttaactatgctgggacatttttctagaattgccacagcttaaaaaatcaatttatgttccgtaggttatcatggggattcttctaccccccaccatcttgtttttggaatttcgcacatatgatgatttctcgtatcaaacatccaaggaaaatgaggatggcaaagaaaaagaagaggaaaatacggtcagtgacacacttgaccctaagcatatcagtgtaatcttgttttcaaaattgttgagatttcttgtaccacagattgagaaatctcactggttaaaggtatttttggaattgtgtttttctaatggtgcctgtgtgccggagtgccttgcatttcccatttagccacctgcctgtcatgtgctgtgctctgttttccaggatgcaaatgcagatgctggctcaagaaagggggatgaggagaacgagcacaaaaaacagagaagtattcccatcggaacaaagatctgtgaattctataacgcgcccattgtcaagttctggttttacacagtgaggcctcctcctgaacatttgacattcagtatattttgaatgctttgatatgttggaatcaagaaaaacttcaagggcttaaaaaagtatctaaaaattcactgaattaaaatgaattatgagaacaaaactgggactaattgagatctctggctaacattggatctcgatatcctgtcacatattgatatatggccatcctagtcccaaatacaccatctcataaggcaaaatagtcacatgctatttgcttaagatgaattcttctgatgcctttagcaatacaaacttaaggaactataattttatttttaaatgaacagagatgactagtgatttaaagagcaaattcacagattccatttttcatgaaattggtggggtcattacaagggcatggctaaatccagatggtaaactcttggaatagggaaacaaatcaaggcgtctcattctgaagtgctcaccaaactgacccgcttggctggcaagccatcctccagccctctctgaggccctgggtctacacagctcccagagtgtggctctctactaacaagaacaggagaggaggcaggagggcagatcagagcgcctctgggggaaatggccgagctgcaggcggtcccagtgggggtggccaggcacactgtggcttgtgcaaccacgtcagtcgggaggagagagacttctcatgaaatcccaagcatcaagccacagcccccgccaggcaggcctcggtgctgtggttgcactggtgatgaggtgagagcagggtatgggacatgaggagctgggtccctggccgtggtctgggcgatgaatgagggtgggctgggggcagagcaaagctctgtgtgggggcccacctcaagggtcagctgagggcctggacacccaaccttgtggcagccaagattgatgatacagtcgaagtcactgctgcccatcgattctggttagaaccatctgagggcctggggtgcacccagcctgcaggagagcccagccatagaggctgctgccggagatggggccaggaagccatcgaggcctctcagccttgggtctcaccccagaccctctggatcgggtggagggtggagtcatcacacattgtgcagcttcgcagggattaggatgcagcccaaagtctgagaacatggctctaatctttcttcaaagagtggatagtggatcttggggtggggcctgcctctctcctggtaaagcttataggcttgggaggcaggatcttgaaaaaaaagaaaaaaaaaccaaactgcccagttacaaatactcagtttttagcacccctcccccaagccttccacaggggcctgtgccagtgagggacccagaagcttaagtttccttggcatcatggtgaatcactggggacaggtgatctacttcagacgtcctcccccaaccccttaactccccgcttttgcctcacccactgccacctccagctctgcctctttccctgccacagagataggggccctgctgtggccacagcaaatcctggacatgccaccagtaactgaggggactctagggtcagctcgcatatctgggtgggcaactcatccacatgtcctctcatctaacttcccagttgtggaaagaatcaggaaggaaatttctgaggcagggaggagtaagtaacattttccagtttccaggaatgtagaagacactccagcaaactattaaaagtttcccgttatcataatgtttgcaacttcatagtttccccatgaggatgacagcaccaaccaatatgtctccatgtagaaaatgaaaagtcagggcccatatcgtgctgaagtataaaatgcctcccgtcctgcctccaggtcttctgtctgcactggtgaggtgcagtgaaggtttcctctcaatgagtcagtccagttggaaacaaagattcttttagatgtgtcaacctgaaagaaaacagcgtttcaaaatttgattgctatgtgattcccccaaacacggctaacagcttgtctttctttcagatatcatacttgggctacctgctgctgtttaactacgtcatcctggtgcggatggatggctggccgtccctccaggagtggatcgtcatctcctacatcgtgagcctggcgttagagaagatacgagaggtggctactccaaaggcctcccccagcccactaaccgctgactgcaaatgcagatatggctccttactgaaaaaacgtttcatgcaaattatgcatgttgggccaggcgtggtggctcatgcctgtaatcccagcactctgggaggctgaggcggatggatcacttgaggtcaggaatttgaaaccagcctggccaacagggtgaatgaaacactgcctctactaaaaataaaaaaaattagccagtcgtggtggtgcacgcctgtaatgccagctactagggaggctgaggtgtgaggatcacttgagatagcagtaattcgaaaccagcctggccaacatggtgaaaccccgtctcaactaaaaatacaaaaattagccggtcgtgtggcagttgcctgtaatttcggctactcaggaggctgaggtggaaggatcacttgaaccctggaggcagaggttgcaatgagccgagatcgcgccactgcactccagcctgagtgacagagtgagagtccatctcgaaaacaaaaacaaaaaaacaaattacacatgctgtgggactttttttggaggtatcacaatcccaagtttattccatttctttatttaagatgtatacatcttgaatgaacttgaacttgcaaatcaaaacacaaggcaaaataaagatatttaataatgaaaacaggtttgaatgcataggaaagcatcagcaaatgctgccagcgacctgagataaaccaattaccgcaactgggcacaaattttggcttagttatttgggatcagagggagaaagagagatacaagagacacttgcacagtgtggtccaaagcccaaagttacaggaaaaatgccatctcttttatctctggactcttgtgcaggagatttatgaagggagggctcccagtcaggaggaaaaggagctaagtgaggtgtggcttcaggtggaccctgtccttggcctaatcctgtagggggctctgagtggactggacactgtggagtctgtctcacctttgggccccacctcaatttgtcattggtacccaccagagacatggctccaagcatctaagagcaagcctcccagaagggggcaggtgtgggcctaacagcagcacctgcagcagatggggtgggcaagcccacctggggaaaagctccaggggatatgggaggggcctagagcgtttgctgcaaacagagggaacaggattttcaactcagtattgcaaaagaacagataccatctcacatatgactcgttatcccagagagctcgagtgaaaatgtaactcccagtaagcaatctctgcagacagcagaggaaagataggccggatacttccctttccaatatcattcagaagttttaattcactaaatttgcttataaagagaaagcatgtatccaagcaaaaaagcaacttgagctgaaaaagcccacagcatcatttcatatcctttctccaactgatatacaaccaatactattattttgcagtaattgttgaccctttcactgaactgaaaaacattattaacctagtccagatagagggaatctgatggcatcggtctaattagagcctgaaaaaccaaaagagcactgaatccaaaattatacttgccaccttctactactgttccttttctagctgggcctcattcaaattctgcaggtgctgcaactggtatttcctgagcggcctgctttaccatcgctgtgccgtcctggccttgctgagggtccaccatacaccgagacactgttctttattccagaaacctgcccccagttataggagagagagggtggccatcggctagtgtgcatgggttgttaaactagtgaatcccttctgtgtgggctgacagatagccactgccccatcctaccacagagatccccaagacctctgcaactgaaggggtaccacctggcatggcaaccctccatcccagtgtggtaccacagacagctgtgccattgggaaggctctgcgcacgcctgtgcatgctgcttgctaaatatcttccattttactctgtggaagtctccccttaagcagcagtgattttgaaaggataatatctcaagtaggggaaaacctggtctaactttcccctaatttctcatgtctaagttgcaaaggaattttgccaaatcaaaacatttcctagtggtattctgccatctccactgggtggactgcccctctgtggggccacgtggggctcatctatgctctagagttttcatcctgtgtgactctggaatgtggagtaacaggcacgtgtccagataattaaaaaagaaatcaaaatgcagctgctttaattacagccagaaggacataatttagaaggcatttcctgagtttgtaaaaccctgaatctaagaatagggaggattccgtggaatttccctttctagatatctctccctgcctgagaagaagagtgtttaaacgttttgagtaggaaaggggccagatgacctggaatgttccatcagtcttattgttccaagattctaagacaagacttctaatacggcatctcagtttattgttctttggggtttgttttcagatcctcatgtcagaaccaggcaaactcagccagaaaatcaaagtttggcttcaggagtactggaacatcacagatctcgtggccatttccacattcatgattggagcaattcttcgcctacagaaccagccctacatgggctatggccgggtgatctactgtgtggatatcatcttctggtacatccgtgtcctggacatctttggtgtcaacaagtatctggggccatacgtgatgatgattggaaagatggttagtagtggcatcctgtgggtatccagagagactttggctgtagttaggacataagaacaggccttgggcatggcttccttcaatttcatttggtttttcttttgcagttggctttttaaaggaaatattctttgctttaagatacacagttctcctacatgttgataacttaataaaatccaatagaaaaacatgagttgagggcctactgtgtatatatacataacatatatacatatatagtgtatatacattcactgtatatatgtgtgtatacatacacacgtacacatgtatatctctctcaatatatatcaggtactcaatatatactgtctcccttcttccataccatatctcaactgtagggtgactaattacgtttgttttttattccttctgatttattattaatgagtctattttgacagcaatataaaagaaaatagcctcgtttttttgtaagagcttacttcactttcccaggacataagagaacatcaatttttgatgcaataggaattcagtagcaaaatagatgtctcaaaatatttacttcttgatggctggaaacatattttcagcattctttagtacagggacatggatttgatgttctatgagactacatccacttcagaatgtatatatatatggccaaaaaaaaaaaaaaaaaaaaccccgcctgatttataacctcctaacatgtggtagaagccggagacaaagggagcccagggccaatccccaacctgtactccagatgatcttcagctcatttactctggcctggagtgaacacaggaagtccatgtgattagaccatgatgacttatactccagaacaggccagagaatatgaaactgaaaatgaaccagcaggtcatccttacattacctaaaagagcttcagtgttaggactggtacaagaagaaagcaagcctcctacatttaggaaggactctttatagggcaagtggttttgagctaagggaagtatgctttagtaaattccagcaagggcctccatcttcagggatgttcaaaattaggaattataccagtttagtatccacagtaaccagggcattgctcagcacttgtgtagtgaatgaataaatgttggtctatactctcaattcattatcgttttatttccttaggtatctgctcctcttcctccttagcatcccttacaaactcccatcttttcttctaattcttccctttctccatttgcagttgtagttactaagggacatgtgtttatgggcaacaacagagaagaagcaagaaggatgaagagcagatgaagatagcaatgttctagaagacattctaggcataaagcattgcatggagtaggaaaaagccttcccagggatgggaagaaaggaagggaaagaggctttcttcgtcctaattaagcactcgtgaagtgcttaattggagacagcaatataatgagccagggtgaacttggcccacaagccaagacagtgagagacaaatgttctccttactcagatgatcgacatgctgtactttgtggtcatcatgctggtcgtgctcatgagtttcggagtagcccgtcaagccattctgcatccagaggagaagccctcttggaaactggcccgaaacatcttctacatgccctactggatgatctatggagaggtgtttgcagaccagatagaccgtaagagtagaattcatagtaagattctcttccctgcttctgaggcagatgatcagttccaaattaatggaagaacatgtattaatttggaaataaaaaatatttgtcactccaccataggcatcaaattattttacaaagaaataagaacaaattatggaacatggattttcagacatcagtcatttcttttattctaaaaataattcactagaattcccttgagctggacctgatggacatcgtgtcacatgaatgcagttctaatgccaatagcctagtttttcttcaacccagtatctccccaccccaggataaggctgatagtgttttccagtagaatgaactagtgaacagagcagagtaactgatacttcccaccatcctcttcttaaagccatcagagcccattttccacatagctacccatttcatacccatttcatcttcactactagagtgctattttgtattatcaaaaataatctggatgttagtagaggaaatgggctatgatcctgcacagatttctggggaatgtaggcccagctcctctgcaggctgagctggtgtcttctggattgaaggaatgtaaagctcaaatgttcttgtacactatttaccaggacagttgaataaatgttccaccagtgaaggaggcacttttagtcccatttccatttcaggaccaacattttcatttgcatgttgtgatttatcataaagcatcagctataatagcatgtctgctgcttccagagctctgctatttgggaatagaaagtttttatcatcttcctctcatatggaatgtagggctgtcagtgtatatctactgcctctaggttagacaataaccagctcatgcagtagcttctttctaacttttataatgtcattctgaccatatcattattgcaagtatcacaaagtcaactattgaagtgtgttagtagcttggtaagccagaacataaaaatctaatttgatttcaaaagaatattagtttaggtagatatacatacacgttaaaagttcctgaattccaggcataaactgtagtatttttattgttgagctcttttttttttaaattaaattgggttatgagagaaggtaaagaggtaaactttaggctgtgctattctcagtaacataattaaatgtaggtttttgattcttgatctattaactaataattttgtagttatttgtgcttatgaggtgtttgtgttggaatatagggagcgcgtgattggttaacctgatcatctgccagtaacatcatgtctttttcacagtatttttaactagtgagcttttgctctcgcttatgacacagggtaaaataaatatccatgatatatattttctagaatgattaatgtatgtaattcttctaaacagatcactgtttctaagtgtgaatcaatatttcccaagcttaaaatatttgcatttcttcacagcaaaacagttatgttgttaaaccacttgttttacttttctctcaaccatcatcttattttctttcctcccctcctgtcaaaacaaaacaaaacaaaaatcctgctttccaatcgtcatgtagtctacgccatggaaattaatcgtaagtttacatggaattgattattctagtctatggaatgtgtttttcaattaccttttccttagctgattactagtagtcttaaactgttttcaaatacttctcttgttttttggtgccagtactttttaagctgtcagtaaaaagtaaagagaaccacaaattcactgttgggatcaccctatttttttaggggagaaatagaccccctatgataaaaagttgcatttcaaatgagcagagggagaaaagattatttttcaaacatggcaccaaaacagttgattaaacaatttgggaagtagaggaaatccctaacccatacaacataacaaaaatattttcaaatttaatgtatcagtgaaaccaagaaaacaaccagaagacaacataagctgatgttaaataattagaagccacaatgactttcaaatggataacgataaagggaaaaaacataaagatacatttgtctgcttaaaaatgaagacttttatatttgaaagccacaataaagaaatgggaaaatgtttagaaatatgacaaataatgactatctctgagcgcagatatgagtttctgacttttttctttgtgtgagttgttttttttttgagacaactgggagtctcgctcagtcacccaggctggagtacagtggctcgatctcggctcactgcaagctctgcctcccgggttcacgccattctcctgcctcagactcccgagtagctggggctacagagtttattttttcccatggaaaaaatattgcttatgaaataagaaagaatcatattaaaaaagaaataggtattgaaaaacatatgtaagagatatttatccttttcattatatgtaaaaagcaaagacaaaactatttttttctttcagctccttgtggtgagaacctatatgatgaggagggcaagcggcttcctccctgtatccccggcgcctggctcactccagcactcatggcgtgctatctactggtcgccaacatcctgctggtgaacctgctgattgctgtgttcaagtacgtgtcacagccgatgaccacatgcttattatttattactgtacagattttccatttaatctcagaacgctcccaagataccaatatatttgcagataatttcattagggtttttaagtagatccaatttttgcagtctctttgttcaaacttaatcagtcttaatgtattcataaatcaagagttgacacttaaatacatttaaatttaatcttggttagtattttaacactttagcatgtattttaatctaatgaaaatattttcttagatgaaagtctcctggggtacagaatatttgattaagtcatgctttttattcatcagcagaggtggaaaaggcaatatgagtttcataagctgttacaattactgtaatactagtaaagcatttttttctgatcatttatagaatacaagataaaatggcctaagaaaaaaatggcttaaagggttaaatcgagtttcttataaaacctgcctatttggcatgttgtgttgagtatgttgaccatgctcaataaatattgaaaaaaatgattttagcttctaagatgaaaaatatagagggaaaaatccttcacagaaatatgcaatcttagaattgaacagggcattggagaaaacctggtccaaacttctggcttgagagatgagaaaactaaggtcagggaaggtaactggttttcctaaggtcccagtattggtagacaatgaaatcatgcacttactgcttcctgttggaagctaaaataagacaaagattgtacctaccccatgtccaaaataacgaaccttcaatcaaataagttcaataactaattaattcagttgaaaaaaaagtagtcatctacttgttagacagaattgaaagtttaaacatgtgaaagcatttagttaaatggcttataccgctacacataggaaattaaatttcctgagtatatgagtagattgtggtgtggtttttcaagaaagcagtacatagcaatttattacacttagctatttatgaatacaatgtccttaagcacagataatccacattgatggataaaccaaaagattggataatcaaggaatcagtactaaagggcactaaaaggccatctcattgagtattttcacttaaatgtgagtaactttgactgctctgggaaatcactataaaaagtaatataactaactgtaaaaatgtcttctttttaaagcaataccttctttgaagtaaaatcaatatccaaccaggtgtggaagttccagcgatatcagctgattatgacatttcatgacaggccagtcctgcccccaccgatgatcattttaagccacatctacatcatcattatgcgtctcagcggccgctgcaggaaaaagagagaaggggaccaagaggaacgggatcgtggattgagtatgtgcagggctcttcatttctaagttgggctgatttcaaaatagtgttcaaattggacatcctcacagaaatctcactcaactacttgctcgtgtgaaaagcaccacactcagtccaactgctgttcttttcaaaaggcttctcattttgtacccattttattctagtttcgttaatttgttagtaattaatattaggaaagccagctcatagagaccagaagttgagctaattctctaaaataactctactctgtaaatttctatataaattcaatgctcctttcaaaacgtcttaatttgttgcatctaaagaaaatgagaaaataatgctatacgtttgactctattcataaaaataagtgcaaaaagttttccaggaaatattacttggctttactttcccagtaaatgtaattttgttttttatgtttaaaagcgggccgtttggctccaactgatagagggttggggcgtatgacaacccctttttagataaaaatcaattggagtagtggcgaactgccttaggagtggcggagaagagagcttaattaaagtggggctgtgaaattctcattgacgccacgaaactgattcttcttgtttttcacgtggccgacacttctcccttcacacagagctcttccttagcgacgaggagctaaagaggctgcatgagttcgaggagcagtgcgtgcaggagcacttccgggagaaggaggatgagcagcagtcgtccagcgacgagcgcatccgggtcacttctgaaaggtacgtgtagcgtccccaccgcgggcccgtgagccaagggtttgctgactcgggcgccccactctatgggggatgccagagttcatttaaacatgcactccgagttctcctgttttatttaaactttaggttttaacgtggttcccacgaaatagtgagaaagttactaggtaataactgtgcattggatatagaagggaatgacatttatttatcctgggccgaaagaaaacctaacagttgactaccttcaccccctaccccaaagtgggggtgtttccgcaaggttaatggaagctacagaaagccatccttctcccagctcttgttcctaacttccctttgcgagcatggtcctccccaggggactgccctcctcatccggcctagctgcttgctgcaccttggcaacacctttcccagcctcacagggcagaggaaaaggctccctcctggggctcccctgagagtgggaactgggaggggtggggtgcagggtggggggtgaggtgtctggccccatgagggtgggatccgctaaactagggcagggtgtgtctttcagacaccttcacatccgcagtacccagcaaggtcagcctaatctccgcggtgatgcttaataaatgcagagtgaatgaatgcaggatgtgtgaaccagtgaatgagtaaatgaagtcaggtcgcgaggtacagaaatggtgacattttccaaacttcgtagtattgctctaccctaagctaggaaagagcaactggcaaagggtagacaggagcaatggaccttcactgtctgcactttttatcacgtaagttttgagagcctttatcatttactaaaagcattttcagcctgctaaagatcttggtgactgataacacgctgttccaaagggtttcactaacaacgtggccagaaggatgagctcagaggagccatgcctagctctgctttctatccttgagtacacagaattaaagtttcctaacagacacattgagagccataaaaacagggtgggacttcaaaaagatattgcagctgacagttcccaaacaattacaacagaattcacagatgcaccttaggtctccctggtgcatgttgaggccagtgaactctgccccagcccacaggaggggagatggcaactgtgggtccctggcctcggttccctcctagacccagtcaccttgtgacccaaccaaatccaaccagctaaactctagggttacctgcaccacctttcttccttaccaaggtgaatttttaataaaactttgaaatgtttctttgatgctttaacagtaattgctaaactttcaaggtataaaaattatttcttcatgagaaagttaaggtaccccatgtaatccaatttccactttttagttagacattaacttgaacgtaattttaaccagtcatttacaatggagattgtgttttgttttgctctgcctccccctctcccttccccggcattccttggatttttaccattcttggaccaaagctgcaagagtgtggttatcaggtcactaccaaattgcatttttctctgggggctctgtgcacacgtaatagggatgaaagtgtgtagggcagagaaaacatgctgcttcctgtttccctcggctgagatcccaggagcgatgggagcacattcttgcccctccatttcccttggccttgtcaggctgactcacaggtgaatgcccaagacagaaagaggagaaggcttgaggagaagggagttttccttccctcttagccaagccagctgagaagcaagggataaggtgggaggatggaaataaaagtagctatttgggcacctgtgactactttaaaaatcacacttgaagtactcaagcatttctgccatttctttaatattctttctatataaaattagttttattttctgcatcaccatttcccatttgatgattttcctgctcttctctcggtcgtgtcttcgccagcactattcagtctgtagggtctggttaggagcatgtcagcccctgccttgtctccctgttgtcttggtagctttcagagctgagctaccaattctcatgactcagttttacaggcgtgttcacacaggatgggtacccattaatcattctcctccacgcagggtgcttttagtgcttctgtgcagaaaccaaattcatggttctctcctaatgtttggaaatttacctataaaatgctaacaatttaaccatttattttttctcaaaaagttccaacattttgtaagatccaacattcagtcctgcaatgagatttgcaatacgattcagcattgattgacacaacactgggtcagtcctaccaaccacgcccacttagatgtcataggggccctgctctcagggttctcctcccaaacttgcactccagtctctgtgaatggcatcgccattaagctcagttagcaaactggcaaatcattgtggcacctccctcttcttcactaacaatcatcaagttctgtttacttcccctcgtgaatacatcctgatccacttatttttttcatccctaccccaacgcacctagtacaggcttccatcattttccacttccattcctgtagctgcccctacctgagctctccatatttgtttctgctgtttcaatccatgttgcactgtcagctctcatggggtcctgttccctcctgcactggctttcctgaaaaaccctctgtggcccccactgtcctcaggcctgcaaggccctgccctctctctggctttgccatgcactatcttctccttcatgctctgtattccatttctctttcatttcctcaaagcactgcttccttcctgccacaggggctctgcatgggctgtgccctctgtctgatgcacctcaccctccttccctgctcctcttccttggatctctgcccaaatgccaattccttatggaaaacttcaccacctcacaccttagactaggtcaggaccctcaggccttaagctgcatgaaggcagggccatgtctgggtttggtccaccatgatatacctagagcctgcacatatccacatagtaggagccagacttttgtttctgtttttgtttttgtttttgtttttgagacaaggtctcgctctgtgcccagtgcagtggcacaatcaggtctcaccacagcctcaacctcctggactcaagcgagccttctgcatcagcctctgaagtagctgggaatacatgtatgtgccaccacgcccagctaattttttttattttttattttagtagagaggaagtctcactgtgttgcccaggcaggtctcaaactcctggcctcagcaatcctgcctcagcctcgagatttttttgaacgaatggatgacttaaaagcttttctcctgattcgaatataaatttctatcccatccttaatgagttccctcatggaatatcaaaaaggaaaccagctatgctccctccaggttcaagacactggttttactataaggaagtaggagcagactcaagagccaaaggattgtgccacaggaaggataacaagtgttggtgttggcaccatctttttgctcaaagggataacatcaaagagccatgagggctggtgggataagaacattttataaacaactccttttttattattatttgtagaaacagggtctcactatgttgcccaggctgatctcaaactcctgggctcaagctatcctcctgcctcagccttccaaaatgctgggattacaggcatgggccaccatgtctggtcaacttctggcagcatggccaaagtagacctcgtcaacccatgtgttctgtcctcattgctccaggagaatatttggcaacatgagtccttatcattgggagatttgaggctatctgtgtcttctgcacatccactacggagcacactgttctctttgtggttcagcatcccttatcacaggttcacaggttcaagagcaattgggctagaaagaatctttcctgacaaaattttgtcagagacccaacttccttttctcaatgagaattatgttatccagtgtgttttccttttttccatggcttcaaggaagcttaacaccaaacttaatattaaattatcaaatatattactataggattttgaaatatgtggggtacgttgcctcttctctgctttttttatatcgtctacctccatttacatacattttattaatgtctgacatttcacaatatgcaggatataactcataaattatacattttaagtgtagttggccttgtgcttaagaagctatgggtcttagatgagctaaacctataatagcattttctgattcccccaaaactttctggattaagtggtttcttgtcagatttgtggatatggattaaagtgttttgtcttttttttttttttttttaattctagagacagggtactgctttgttgcccaggctggagtacagtgggatgatcatagctcactacagcctccagttcctgggctcaagtgagtctactgcctcagcttcctgagtagctgaggctacaggcgtgcaccaccacacccagctaatttttgcatattttgtagatacaggatctcactatgttgcccaggctggtctggaactcctggcctcaagcggtcctcccgccttagcctcccaaagtgctgggattacaggcatgagacatcatgccccatcctggattgcctgcaggcttgatgggaaatcagcaatttgtggctttgaaatctttttatttggcatcctcttcccatgtgaccagaaagagaaatggctggtaatggagacctacctagaagaaacaagatagtaactagaggaactgaaagagagatcagtcttaggaaggaggtgggggattctttgcatgtagagaaggttgtagaacggcaaatgcgcagtgatggggaagacatttggggatgatcctgtctgaataccttaatcttctaaattcatagggttcaaggttgcttggataataggaaggagatggcttaaatgttgaaattttgatgtgccagtggatgacacccttgttcctgatctgactttgaaagccaattcagagacagatgcagacttcaggaggatagagaaaaaaaaatcagttttattagtaataaaagttgtactggagggtgtggcttcgttcttgcctactactcacccagaattaggaatacccacttagccacaggcagcaccagccaccacaggcctcgcttcccacaggcagagtttagcctgcgcgctaagcctaccagaagaccaagacagagagacaagcatgcagtatcctggtccccaatctccaaccaaatgagccgtcctcctccaaaataaataaaggcctggaatgaggtcagagcattactaatgaaaagtccacatacatagaaagaaaaactaggcatgggcaaagtgtacctctccaacaatcaacatcactgacttaaagccagtaggaaggattcaagtcaagtgagttcacttttagggggaatatggcaggaaaggagataaccaggattgcttggcaggaataacaaagatgcaagttaaattagataacatggctttgtactgggccaggtcagtgtggttcccatgaccttcatcggtgacaccgtacagccgaaaggcagggatacagaaagacaactgtacatacggcatggatgctgaaggaggccatgcgcccaaaaaccagtctgtggagagacctcaaagatgctagtgtttgcaaatggcagcataaacatacgacattgcctccaggcaccaaatatccttgcttagtcctggagtcctggtagcaataggttgggggttagggattggcactaacgtgttgcaagtaagggagaaagaacataggttattaatgagggcttcacttcgtggccaaccacagaatctggcctgaatagaaaacagaacataaccagaaaaggctaatgattagatgacttgaattctataaacccaggaagtctggggtatgtttaaatgaggcagcatacagctagaatcccagaaagcttaatgttcttttagtaactattcagtatactgtttattacagagaatgaaaaagccagaagaaagacatgagtcttggccgggagcagtggctcacacctgtaatcctagcactttgggaggccgaggtgggcggatcacttgaggtcaggagttcaagaccaacctggtcaacatggtgcaaccccttttctactaaaaatgcaaaaattagccaggtgtggcagcgaaaggcctgtaatcccagcactttgggaggccaaggtggatcacttgaggtcaggcgttcaagaccaacctggtcaacatggtgaaaccccgtttctactaaaaatacaaaaattagccaggcatggtggcgaaagcctgtaatcccagcactttgggaggccgaggtgggcagatcacttgaggtcaggagttcaagaccaacctgaccaatatggtgaaatcctgtctctactaaaaatacaaaaattagctgggagtggtggtaagcatctgtaatcccagccactcgggaggctgaggcaggagaatctcttgaacccgagaggcgaaggttgcactgagccgagatagtgccactgattgcactccagcctgcgtgacagagactccctctcaaaaacaaacaaaaaaaagaaagacgtgagtcttgttcttttatgattagtcttcatttagtctttcacacataaaaactctgtaagtaagcacaacaaggttctatcctggtgttcttcctataactactaaatgtaaaaggcagccctgtatgaagaagtggatggaaattaaaatagctggatgtaaaatttagagtggataagacaactttatgatcagtagttctggaattaaattatagggtaggaatagttttagaactcaagtatagaataccatgggatcttgaaacaggggtttcttcaagtatgaactggacctagctccactaacatcatgtctttatgttaacatttaactctatcattaaggaaatgttcccatataatttatgagattccttgcaggtgaagggcaactgtttcccatgaaaagataactgcatataaaacaagttttaggctgggcacagtggctcacgcctgtaatctcagcactttgggaggccaaggtgggctgattgcttggggccaggagttcgagatcagcttggccaacatggcaaaactccatctctactaaaattacaaaattagccgggtgtagtggcacatgccagtaatcccagctactgaggcacgagaatcacttgaaccggagaggcggagtttgcagtgagccaagattgcacccctgcactccagcctgggcaacagagtgagactctgtctcaaaaatttaaaaaggccaggtgtggtggttcatccctgtaatccagcactttgggtgctgaggcaggtggatcacctgaggtcaggagttagagagcagcctgaccaacatggtgaaaccccgtctctactaaatacaaaaaattagctgggcatggtggcgcatgcctgtaatcccagctacttgggaggctgaggcaggagaattgtttgaacccaggaggcataggttgcagtgaaccgagactgcaccattgcactccagcctgggcaacaaaagtgaaagtctgtctcaaaaataaaatgaaaaataaaataaatttaaaatttaaaaggccaagtgtggtggctcacgcctgtaatcccagcactttgggaggccgaggcgggcagatcacctgaggtcaggggttcgagaccagcctgaccaacatggtgaaaccccatctgtactaaaaattcaaaaattgccaggcgtggtggcacatgcctgaaatcccagctgtttgggaggctgaggcaggagagttgcttgaactcgagaggcagaggttgcagtgagccgaggtcgcaccactgcactccagcctgggcgatagagcgaaactccatctcaaaaataaaataaaataataaataaataaacaaataaataaaattaaataaaacaggttttaacaactggcttactacagaactccagatgtttcagtccttcctaggaaagacacacagggactcttaccacaaggacatgagtttggaccttatgtttaatagacaagagtctatgcaaagtccaataaagttatgccatacataggtattctcttggaagttaatgcaaaagttccacaaattcaggtattgccatacctattatttgaatgaaacagaacacattatgtacaaccccttaacaaaaagtatgttttcatttaaccaccttcaggcttagtggcatcatgttcaaaatcaaatatccttaataatagatataccccaatatagagaagatttgcaatgatattcacacagccatgtcctttgacacttgtgtagcatttacagttcacagagcacacagtttcatttaattcatttaatttagttgctgtcatgctgcaactgttgttaatgtttgataaatcactccccagggacagaagtacaataaagaggggctggtggagtagcttcatcccgaatgccaatgtggatgggcacatctcaaagggaacactgacactggccatatgttaatcagaaacagcttttgttttttctcaaaaccaaattaaacaaaaagagtcatgacatgtaatatcagttgttaatctggtacaatcttttactctattttatttatgtattttgagacagagtcttgctctgtcgctcaggctggagtgcagtggcgtgatctcggctcactgcaacctccgcctcccgggttcaagcaacctttgtcctgcctcagcctcccgagtagctgggactacagacgcacgccaccatgtccggctaatttttgtagttttagtagagacgggggtttcaccatgttggtcaggctggtctcgaactcctgacctcaggtgatctgcccaccttggcctcccaaagtgctaggattacaggcgtgaaccaccacaaccggccgactttcttaatttaaaaaacaagttttttttttgtgtgtgtgtgtgtgtgtgtgtgtgtacgccaggttttgagactgattagggcattcaggtgtatccttttaacagaaaagcccaaagatttaatctgtgagtcaaaagatgaatatgggcgtggaggatcacagctattattaatcatgactgattaagcacatgcggttctgggctcctcgtgactttagtagcagtacacatgatgcagttaaggacagagcaaatattgtaataaatcaagtgcagcttaaatttctattcaaagtcaggagaatgattaattggggcccagacagtttatagatttcatttgtttatagtttcctttgatacaaaaggatggagagtggccctcaggaattgctcttaggcctgccagttaagaaatcatgtatttggtggttagaaaaatggcctcattaatgaccttttcaaaagtattcataagtggaatttttttctgtgaagtcagtgctaccataatgtgaaaaataaaaacctagtggagctatttatagcatctacaagtaaatccaaacccagaaatagttacagaagccacaaacttcaattagagggaaaggaagataatcaacctgatcagaaatcagtgtcaccatgtgtaagaaagcacactttgcatcacaaaagtaccactattcaaagaaatcatttattagtgctgaatacttgttatactaaaaacatagttataagttatttcactatgtgatttgaaatatttgagggtattggcatattttgtaaagtgaatattattttgaaaaatttcgcaaaccctataataaataacacagccatgataatctaattaaatcatgcctaaagccaggatagtaacgtacgtttacatgcaatggctgaggtccctgacatcaccaagacagctttcatttatctagttcttccacaaacatcagaggtagctgaaagctctaggacaggttttctcacagctggggtcatcaaatgccttggcatttggggttctcaagttctaagattattttattttttaattttgatgatgacggcatgtttgcaaagggtccttgaggaaatgtggggatgaagaacaagatgagacaggatgggaagatgagggcagattctcaagagctttgaatgtatatgagtaacagaaatctctatagggtgttaagattaagggctgccatggatggaaggaaagagttaaagctacattttcatagcactttacatagtatgaggaagtgtcaatgtccaaattgtagaatagggttgccaatggagattataaggttttcctttaatacactctttggtttgttcattgcattcaacactgcaatgaaattgtgtttttatcttaagtgtgatgggaagctgctattgttttaaagcaaagattgacgtgcttgtgtttctgtgctatctttttggagtgagaagacattggaggcaaagaggctgttccttataactaacattttttgctttatcagcttggggtacaacatgaggtcatatatcttttttctttttctcttcttttcttttttttttttttaagacggagtctcgctctgtcacccaggctggagggcaatggcatgatctcggctcactgcagcctccgcctcccaggttcaagcaattctcctgcctcagcccccaagtggctgggattacaggcgcatgccaccgtgcccagctaatttattatttttattttttagtagagatggggttttgccacgttgttcagactggtctggaactcctgacctcaggtgatccacctgcctctgcctcccaaatgctgggattacaggcgtgagccaccgtgcccagccaaggttatatatcttttaatattaaatgaaattattctttgacctcatctcatctgcttataatctcatctgtttattccaagagtacctttttccctttctattgtcccatagccccacccccaccccctgcctcaagtcaggtgcaggaaatccagtggtctggtgaagtccctacccactgcatcaaaattcaagagggtgaagtcaatcgttgctctttgctttgatttgagccccagctttctggttggaggatagaaaacggaaactctgaggaactggagatatcagggagatagtgagagggggaacttggaaaagtaatgccataaagttatgaactccagagctcacctgcagactgtgtctgtcaggggtggaggagtctgctccttattcacataccaaaggcattgaatggggtgacatgaacaaaagcaggtagagtaaggaactctggaattctgccccaccataaaagcaacaacaaagttggcaaaaactgtcagagtctatatcttgtggcactctggaaattaagcaatggcttattaagcaacctagggcattcttatttaaacaaaatggctggatcttgataagaaaagtgagctttgtgacattttaacttagccctgtcctatcctctgctctccagttgagtagtcaccttgaaaacaacaacctgcattcctagtaccagtaggagcagaaagaatctcatatgcaaagaattataattacttgttttgtaattacagggcagctccttgaaagcctagctgaaaggttcgtctgtatttcacctgagttggaacaggcccagtactaaagcttctagttagaaggggtggaggaagggttgtcaaaaacatttacaggcaaagggtttagtgcttgctccctgaggtgacggatgacagctggggcaaacaatagactaaccaaaaaactagggagaaaaactgatgtccataagagctttgaaaagctctaacacattcctgggaatttagaaagctatgtgcatgcatagggctgtgtgtatactcaggaagacctgagaaggctataagctcatttctggctgacttgatcttgaggctctgtgcaagcaggaagtgaaagctaaagcaaagatgtaaactgcctgagtgttgaagatgtgcccctatatacacatacagcttctcagaaaagactagaagattttgttgtttttgttccacacatttaaggaaatctctaagtattaactgaccactaagctaataaaatacaaacttcagtggccacacaacataaagaatatagactttacaatattatttcagaaaaatcactaagcaaacaacaactacaaaaatcactaaacaaacaacaaacaacaactacactaaacaaacaacaactacactaagcaataacaacaagcctgagaggggagagaatctgatttctagaattgccacattataatactcaacatgtccacttttaaataaaaatgacaaaacatgcaaagaaataagaaactatggtccacacacaggaaaaaggacaatcttaaaaaccatcccttaggaatcctggatattagatgttttagcaaagagtttaactcaactattttagctattttaaatatatttaaagacctaaaggaaatcatctctaaagaactaaaggaaagtatgagaaggatttttcaccaaataagggactatcaataaagaggtggaaattatatcaagtagtagacgaggtctcaaaaaaaaagaggtagaaattatatatatttttaaaaaaataggtcaggcacagtgactcatgcctgtaatcccagagctttgggagaccaaggagggaggattgcttgaagccaggagttcaagaccagcctgggcaacagagcaagacaccatctacataaaatcatttttaaaactggacaggcatggtggtgcatatcatggcaactggcagagcatggtggtgccggtagtcctagctacttgggaggctgaggtgggaggattgcttgagcccaggaattcaaggctgcagtgagctgtgatcttgccactgcattccagcctggacaatagagcaagacagtgtcaaaaaaaaaaaagaaaaaaaaaaagaaaaagaaagaaatgaaggaagggaaggaaattctgacattggaaagtacaataactgaaatgaaaaattcactctagaggcccaatagcacatttgagcaggtagattaaagaatcagcaaactggaagataaatcagttaaaaattacccagtctaaggaacagggggaggaaatgaagagaaattgaacagtctgaaacctgtagaacaccatccagcagaacaacataggcatcatgagagttatagaaagagagaagggaaactggcagaaacaatatttaaagaaataatggccaaaattttacaaatttaatgaaagatacgaatctacatatccaagaagctcaatgaactccaagtaggataaactcaaggagatccataccaattaacgttatagtcaaactgttaaaagccaaaggaaaagaatcttgaaagcagcaagagagaagcaactcatcacatggaaaggatgcttaattagattaaaaaagctgacctctcatcagaagccaggaagaccagaagaccttgggatgacatagtcaatgtgctgaaagcaaaacaatgtccactaaaaattatatatgcagcaaaactatcctttaaaaatgaaggataaattaagatattcccagataaccaagaactgagagaattcattactagcaaacctactatgagggatactaaagatagtttttcaggcagaaatgaaaagacataagacaataacctaagatccacatgaagaaataaagaggaccagtaaatttaactacataggtaaatataaaaggcattataaatgtattttttgtttgtaactactttttattttctacatgatttacaagacaaccacataaagcaatcattacaaatctatgttgatgggtacacaatgtacaaagttgtaacttgtgataataacagaataacatggggggaggatggagctttataagagtaaactttgtgtatattattgaaaataattggtgttaggccagatgcaagggctcacacctctaatcccagcactttgggaggcgaaggcaggtggatcacctgaggtcgagagttcaagaccagcctggccaacatagtgaaaccccatctctattgaaaatacaaaaattagcctgtgtggtggcacatgcctgtaatcccagctactcaggaggctgaggcacgagaatcacttgaacctaggaggcagaggttgcagtgagctgagatcttgccactgctcttcagcctgggcaacagagtgacactccatctcaaaaaaaaaaaaaaaagtaattggcattaaattaaagtagactgttataaattaagatgttactgataatccccagggcaagcactaagaaaataactgaaaaacatatgataaaagaaagaacaagagccaggtgtggtagtgcatgcctgtagtcccagccactcaagaggttaaggcaggaagatcacttaagcccaggggttcaaggccagcctaggaaacatagcagggccccatatcttaaaaaagaaaagaaatactaagtgaattaaaatgatacactagaaaatacctatttaacacagaagaaagcagtaatgatggagttgagggacaaaaaaaaagacataacatatagaaaataaatagcagtatggcagaggtaagttcttccttaccagtaattatattaaatgtaaatagataaagctctctaagacagagactagcacaatgaatatttaaaatatggtgtaattacatgctatctgcagagactcacttcagattcaaagatttttaaagttttaaagtaaaaggatggataaagacatttcatgcaaacagtaataaaaaaatagttggagtggctacacctatcaggtaaaatagactctaagacaaatattgttactagagacaaagaaggacatgatagacatgatataatgattaaaaaggtaactatatcaaaaagatataacaattataaacatatatgcacccaatagcagagcctcataagatatgaagcaaaaactgacagaattgaagggagaagcagatagttctcaaataatagttgtaggctctaatattcaactttcactaatattagaactagacagaagttcattaagaaaatagaagccttagccaatactatatgccaactcaaggtaacagacatcagtagaacactcaatgacagcaaaatatatattcattttataagcatatggaacattttccaagatacatcatctgttaggccataaaacaagtctcaataagttttaaaaagatttaagttaaacaaagtgtattctcaggccacaacaaaataaaatgataaattaataacaaatgaaaatttggaaaatttacaaatatgtgacaattaaacaatacactcttaaataatcaatagatcaaagaagaaatcacaagagaaattagaaaatacttcaaggcgaacaaaatgaaaacacaatataccaaaatttatgggatacagtaaaagcagtattcagaaggatatttataactataaagacccacatgtaaaaagaagaaagatctcaaagacagtaagaactgaagtaatgaccagactgctaccaaggtcccagactgactactgggctgcacgcacataggtcagatctcaatagcactacaaagactttgaaaactgaactggcattggaatcacagtccacagaaagcatgtcagaacttgcagcctgaaactaaccaggttgatcacctgctaaaacaaaacaaatcaacattctccatgaaaattaaacaagattcagagtcatgtggtataatattcaaaatgtcaggctacaatccaaaatcatttggagtatgcagaatatagaaaatctcaactcacctggggaaaaaagacaatcagtaaatgtcaatgtcaagataacacagatgttgaaattatctgacaaaggctttaaagcagctattaggaaaatgctttaacaaaattgcaaaggctctggaaactaatagaaaactagaaagtctcagagaaagaatagaagatattaagaaaattcaaagaaaattttaccaaaaaataaagtaagtgcaatgaaaaattcattggataggctcaatagcaaaacagggattacagaggagagagtaaacttgaagatattacaacagaaaattactcaatttgaacaagagagtaaatgggctaaagaaaaagcccaaagcctcagagaagtgtggggcaataacaaaaggtataacatttgtattataagagtcccagaagagaaagagcatgatgcagagaaactacttgaagaaatcactgaaaacctcccaagtttgatcaaagacgtaaacccacagattaaataaatgtagagaatgctaaataggactaactcaaatgaatccatatcaaatgaagggccacaaactaaagacagagggaaaaaaattgacagcaaagaaaaaaattgaccagagaaaaatgatacattacttactggagaacagtgatttgaatgatggcagatttctcatcagaaaccttggaggtcagaaggaagtagcactatgtttttaattttaaattttatttattttttgagccgaggtctcctgtgttgcccagactgaactcaaacacctgggctcaagcaaccctcccaccacaacctcccgagtagctgggattacaggcacaggtcaccatggcctgcattatgtttttaaagtgctgaaagaaaaaaatgatcaacccagaattacatactcaacaaaaacattcttcaaaaatgaaagtgaaaaaaaaaatcagacaaagaattcattgctagcagaccaattctaaaagaataactataggaaattcttcagacagaaggaaatgataccagaattgaacttggaacatcaaaaatgaaagaagagcatcagaaataataaatatgttgataaacataaagatgagtcttctctttctgagttctttaaagtatatttgacagtcaaaagcaaaaattgccatactgtctgatggcattttcaatatatgtggatacaatatatgacaactgcagcacaaagggctatgggaaagggacctgtatggtagtaatgttcctacattcaaattgaagtggtaaaatactgatgctatgtatactgtgaaatgttgctatctatttgtaatccctaaaacaaccactgtaaaatgtatagtaaatgctgtggtcacttcccacctcatttcctgaggccatcatcaccatgataccaaaaccagacaaagacaattgaaaaaagaaaactacagaccaatattcctcatgaacatagacacaaaaattcacaacaaaatactagcaaattgagtctagccacgatcaggtagtttatcccaggaataaaaggctaggtcaatatttgaaaacaatcaatgtaatccaccatattaatgatttaaaggaaaaaaccctatatgtttctagcaattggtgcagaaaaagcatttgatgaaattcaacatcatgatgataaaaatacattttataaaagtctctcagcaaactaagaacagaagagaacctccttaatctgacaaatggcatttacataaaatctatagctaacatggtgaaagacagactgctttctccctaaaactgggaacaaggaaggatggccactctcaccacttcaacagtgtactggaagtcttaggccatgcaataaggcaaggaaaaaaagtcttctgtcttggagagaaatacataaatacataaaaccattcctatttatagatgattatctatgtagaaaatcacataaaatctttaaaaaacaaaatgaaacaaatgaaaacgtcctagaattaataagtgaatttaacaaggctacagagtacaaagtcaacaaaaattaatcttatttctatataccatcagtgtgtaattgaacattggaatttttaaaataataccattctcacagagctccaacaaaaatgaaatacttaggtataaatctcgtaaaatacgtatgggatctatatgcagaaaactacaaagtgctgatgaaagaaatcaaagatcacttaaataaatgggaggatataccatattcatgtattggaagactcaacgtggcacagatgtcagttctccccaagtttatctgtagatttaacacaataccaatcaaaatcccagcaggatattttgtagatataggtcaactgttgttgttgttgttgttgttgttgttgttgttgttgttgttgctgcgctgctgttgttatagacgaagtctccctatgtttcccaggctggtctcaaactcctgagctcaagcaatcctcctacctcagtctcccgaagcactgggattgtaggcatgagccactgtgcccagctatgtcaacttattttgaaaattaaatggaaaggccaaggaactagactatgtaaaacaattttgaaaaagaagaataacattagaggaatcacactatccagttttaaggcttactgtgaagctacagtaatgaagacagtgtggtcttggtgaagggtccaacacatacataaatggaacagaataaagagtccgggagtagatctacccaaatagagataattgatttctttccccaaaggtgcaaaactaattcaacgacgaatggatcatcttttcaactaatggtgttaggacagtttgacattcttatgcaaaaaatgatctcaacacatacaaaaattaactaaaaatggatcatagatctaaacataaaacacaaaactataaaatgtttggaagaaaacataagagaaaatcttcacaacttgggaatagacaaaggattcttcaatgcaacaccaaaagcataatcatgtcaatcatatatctgacaaaagacttttatacaaaatatctaaagaactctaaaacccataatatggaaaaaatggcccaataaaaaaatgagctaaggattagactagacacaccagagaggacataaggttgttaaatatgtacataaaaagatgctcaacatcattagctatcagtgaaatgaaaattaaaaccagaatgagatatatctacacaccgaatacaagagctaaaaataaaaaaaattaaaaataacaatagccaagaaggatgctgagcaactggaatttgcatacactgctagtaggaataaaaaattgtacagccactctgaaaaatggttgggcagttgcttataaagttaaacatacatttaccctatgaatcagcaatctcggctatttaactcctaggtatttatcctacagaaatgaaaacatgttcacacaaaacctgtacatgaatgtttatagcagctcttttcatacttgccaaataatggaaacaacccaaatgtccttcaacaggtgctgtggcacatccatattagaaatatatctttgccaggcttggtggctcatgcctgtaatcccagcactttgggaggctaaggcaggtggatcacctgaggtcaggagttcgaggccagcctggccaacatggcaaaaccccgtctctactaaaaatacaaaaattagtcaggcatggtggcgggcgcctgtgatcccagctacttgggaggctgaggcaggagaatcgcttgaacctgggagacagaggttgcagtgagcggaaattgcgccactgtactctagtctgggcaacagagcaagactccgtctcaaaaaaaaaagaaaagaaaagaaaagaaatctttaagagagcatcaaccttaattaaagggaaagccaagtgaattacttggatctggaatgcttctgtattctgtaatgtgctgaaaaatatttttcactctgtgctgaaaggaaagctggattaagacttagaaagctacacaaataacttctttgctgattaatcatatctcactatgagctctatcatgcatgatggattctcttgtgtttttatgccattcaatgtgtaaatagatgtggggctcttgtcaaattgattcctagatagcctttctctgtctgaaatggaaaccactctttgtgtgggtgtcaaggtttgtgaaacatgttttaaataattatgggaagtcaccaaccatggttaacaaaggagatagatcctcatttatttgtcctttatgttaatcatttcagatgtaagtgaacttaaactcatttttatctttcttctttcatacgtactataaaactcaatgcaacttcccatcgtttggcatagctgtttaaaatttgctgtatccacgttgtagctgttcacaagctccaaacaagcaactgacaatttctctgaacccagggcacatcattaagcattgtttcttccacagcttcaatgaagggagcagcagtagggatgggagatttgagacaccaaaaaaggagcttggtaactgattcaatgcagaggggaggggagaggagagaagtgaggggagggagttagtataagggagaccaaagaatccaatgactttgaggtttgtttttcatatatgagtggctgagagtgctgttatctgaattaggtaataaaggggaaaataggtaaaactataaaagatttgaaaggaaagatattcatcttcatttcaccagtgtatttatttagaaaagtttgcacagcggcaatatctcttactgtatgtttgtaaaggaactcaagtttgactagggcaatgtggggttttttttgatacaaaaggaataatcagggtaatagaactgaacggagtagggagcctttatttatttatttatttatttatttatttattttttgagatggagtctcgctctgtcatccaggctggagtgcagtggtgcgatctcggctcactgcaacctccgcctcctgggtgcaagcaattctcgtgcctcagcctcccaagtagctgggattaccggcacacaccactgtgcccagctaagttttgtgttttcagtagagacagggtttcaccatattggccaggctggtcttgaactcctggcctcaggtgatccacccgccttggcctcccaaagtgctgggattacaggtgtgagccactgcgtgcggccaggagccattatttttaatgaagaacaccaagtcttactcagaagtaatggaaagttaatagtgaaaaattcttctgttggtctctgaaatgcaagaggagagagaacccttagaacctacagtgcctgtgatacagaggctttaaaaaaaggaagccaggacttctcatgcatggtgaatttggtcctccctggtggcaaacgtccaggaagccagacccttcctgctcaaatgatgtggtttcctatagtacatataaatagttctcaccccaagaaaagagttaagaatagaagccaaggaaccacacatacaaacacagacacatcagagcacagttgtcaatgtggtcaacagaagagtggcattagcaaaaaaaaaactctgggaggtggggcaaggtagccacagaagcagcagggtgggggtggagttcaggagatgcagtcaagcacagagctgacttagcgatgcaaacagtggcaggcaatctgctcagaagacaaaagagcggggtggctgaccaccgtgaaatggatggataagaggagagccagcagtacgagtgaggacatgtataaggatgtgcagagaaggtagcaaagaccttcgtaggtcatacagactgcaatgcaagccaagtctccctatgtttttaagaaagctgggagaaaataaaagaataatggaatcagacctaagtgtttgccatcacacagggatgaaccagccagaacacagtagccaggactcctagctccatcctggggacaaattcaacttttagaaagcaatcctcaatcctgggcataccttgcctcttagagttaaattcctattgaaataattcatactgtatgtagtaaaatataaaacaaagtctgtaccagtggattttaggccaggcaacattatggtttcataggctgttgcccgatcttctaagaactgaaaaaaaaaaaactaatagcaggcatttataatctcccatgctcttttttgtgtgtaaccttaaggaaatactaattattaaatataaagaataatttaaagtttttggtattcttcagacaattaaatcacctactatcctttaagcaaactatctgataatctgaacttaattattaacagtttattttctgaatcccttgaacctcaataaggattttaattttatttattttgttataaccattcactgctgacagccatagtcaaagctctaaaaactaagcactagtagcttctgttattactacaggcagcatgatgtaccagctaagagacaggcaccggagtgagtgctggagctaggctgcgtgtgctcaaattcctgctccactgcttcctacctttggggaaattacttatacgctccatgacttaatttcctcacctgtaaaatggagatgataataatagacctacttccaaggactgttctgaagattaaataagcctaggattgaacctcagtaagtacctgttagtgagaacattatgctcttagaacaatgactgagcagtaagtactatatgcattaactatttatttccattattttctggtggctcctcatggtaattcgagtagtcatgttaggggattgtgaagcttgtaaatatactcaaacagttccatatgtattaaaattctgaaaaatcacatagcaatgacattatcttttgatttttaatatccacttaatctcagtttaataaatctatccctttatattcaccagagttgaaaatatgtcaatgaggttggaagaaatcaatgaaagagaaacttttatgaaaacttccctgcagactgttgaccttcgacttgctcagctagaagaattatctaacagaatggtgaatgctcttgaaaatcttgcgggaatcgacaggtctgacctgatccaggcacggtcccgggcttcttctgaatgtgaggcaacgtatcttctccggcaaagcagcatcaatagcgctgatggctacagcttgtatcgatatcattttaacggagaagagttattatttgaggatacatctctctccacgtcaccagggacaggagtcaggaaaaaaacctgttccttccgtataaaggaagagaaggacgtgaaaacgcacctagtcccagaatgtcagaacagtcttcacctttcactgggcacaagcacatcagcaaccccagatggcagtcaccttgcagtagatgacttaaagaacgctgaagagtcaaaattaggtccagatattgggatttcaaaggaagatgatgaaagacagacagactctaaaaaagaagaaactatttccccaagtttaaataaaacagatgtgatacatggacaggacaaatcagatgttcaaaacactcagctaacagtggaaacgacaaatatagaaggcactatttcctatcccctggaagaaaccaaaattacacgctatttccccgatgaaacgatcaatgcttgtaaaacaatgaagtccagaagcttcgtctattcccggggaagaaagctggtcggtggggttaaccaggatgtagagtacagttcaatcacggaccagcaattgacgacggaatggcaatgccaagttcaaaagatcacgcgctctcatagcacagatattccttacattgtgtcggaagctgcagtgcaagctgagcataaagagcagtttgcagatatgcaagatgaacaccatgtcgctgaagcaattcctcgaatccctcgcttgtccctaaccattactgacagaaatgggatggaaaacttactgtctgtgaagccagatcaaactttgggattcccatctctcaggtcaaaaagtttacatggacatcctaggaatgtgaaatccattcagggaaagttagacagatctggacatgccagtagtgtaagcagcttagtaattgtgtctggaatgacagcagaagaaaaaaaggttaagaaagagaaagcttccacagaaactgaatgctagtctgttttgtttctttaatttttttttttaacagtcagaaccactaatgggtgtcatcttggccatctaaacatcatcaatttctaaaaacattttccttaaaaaattttggaaattcagacttgatttacaatttaatgcactaaaagtagtattttgttagcatatgttagtaggcttagttttttcagttgcagtagtatcaaatgaaagtgatgatactgtaacgaagataaattggctaatcagtatacaagattatacaatctctttattactgagggccaccaaatagcctaggaagtgccctcgagcactgaagtcaccattaggtcacttaagaagtaagcaactagctgggcacagtggctcatgcctgtaatcctagcactttgggaggccaaggcagaaagatagcttgagtccaggagtttgagaccagcctgggcaacatagtgataccccatctcttaaaaaaaaaaaaaaaa

SEQ ID NO: 50 - DNA, 51020 bp, Homo sapiens
gcgcggcgaagctgcggccgcgacttggcgaggtggtccctaacgttgccgctcggcatccttagaaccggccgcccctgacgccgcgcggggaccccagtcgcccgcgcgccccatgcgctcactcttcggtgcccggccgggccggcgcctcgcagacgcggagccgcgcgggtgacggcacaggcggctgcgcgcccagcccagcccagcccagcccgaggagagggcgcgccgcgcccccgccccccgcccgctctcccgaggccgtgggtgcggatgcgcggctgacgactcgcagcaagagcaccgccgccggccccagcccgcagcatggcagccgccgcctatgtggaccacttcgccgccgagtgcctcgtgtccatgtcgagccgcgcggtcgtgcacgggccgcgggaggggccggagtcccggcccgagggcgcggccgtggccgccacccccacgctgccccgcgtcgaggagcgccgcgacggtaaggacagcgcctcgctcttcgtggtggcgcggatcctagcggacctcaaccagcaagcgccggcgcccgccccggcggagcgcagggagggcgccgcggcccggaaggcgaggaccccctgccgcctgccgccgcccgcccccgagcccacctcccccggcgccgaaggcgcggcggccgcgccccccagcccggcgtggagcgagccggagcccgaggcggggctggagcccgagcgggagccggggcccgcggggagcggcgagcccggcctcagacaaagggtccggcggggccgaagtcgcgccgacctcgagtccccgcagaggaagcacaagtgccactacgcgggctgcgagaaagtttacgggaaatcttcgcacctcaaggcgcacctgagaactcacacaggtcagtggggcggcgcgggcgcccggatcgcgcggacggggtcggcgcgagctgcccgaccacgcccccggagtccccgatggggcgcgaggtgggggccgggcgggccggaacgcccggggcctcgccccttcccctgccgctccgacccgcggctggccccgcgcgtcgcgcgaggcgggtcttggctctcggagccggcgcccgccaggcgaccgcgcccccgccgggcacgccccctccccgggcgcgctcgggtggggccgcgggggcggatatagtcatctgggctgggggcggggacccctcccggccgggaggcggcgcgggcaggtgcgggcggcctgggtgtggaccgcaggcggcactcgtgacggtggggcgcccggagcgggggcaggggacgctctccggggtccctcctcgtttcctcccccgctgcccgggcgcgcgctcaggaggggaggggccggccccggcgcgcggcgggcgaagttcacgcagggacaaggtttccttcgccactcggcacattcttcgctctcttcttcctgtaatttttccagcgctctaaggtttaatttgtcgtaaccaaagtcagcggcggcgcttggcgatgcggggggcggtcccgggtcccgctccccgcctgcggctctttgtgggagcccccgcccatccggcccggcgggggcgcgcccggccctaggctcctcggcctcgaggctctctccggaaaggaatgccctggccgctgcccatcctccgtgctgccctctcgcctgcccacctctcacctgccctgggccggtgcggggcgggcggcacctgcaccagggcgggcgctgagcctccagcctggggatcaccgcccgcccccgccagcccagcggcaacagttcccacgcgcggcccgatactttgtagttgattcatctgtggcggttccctcccccctttttgtttcgtttttaacataaagatgaaaatattttaatggacggcaatccttccccattttggtgtaaagaattgtatgcttcctctgagctcacgtgagttcttctgtgacactcacctcttctaccttgggggcaggctcaaaacccgtctactgaatactgttgtcttgtgaccaagggtggtggtctctcatttgtaaaatagttcacatagtgattaaaaggcataaaaagaagctgcagccttggataccctagagctgaaggccccttttttttaccatttggaactgaaagggcccaaggtctgcaggtgaggctttcagatctcggactaactttccccagggaggcttttgtggccgctccaaaccacgtggcaggtgatggggtagagggtgagagcggggccatttctaggcattcggggtcagttaagggtgtgggggctcaggttgggggtgggagtcagtgtgggctcagagttcagctcgggacgcggctgcagggtgggtgtggccctgggggaggggccaggctaggctcagctcggctccaggtggatcctgagtatcgggtgggggcagcgattggggcgtggctggggttgagatccgctttgggggatgatgcccgtgctgggcaggatacttaatgtttgggaaatttttctacggcctctgtcagggtggcctgccactcggcagcaccggtagcggggaattgaggaggggggtggccgaggggaggggctcgccgtcgtgggcggggccggcttgtcagggcctcagccttgggatgtcttcctggtgggttcatctcccgcttcaggctctggccccgcgcgagcctcttgactagaatattggcgcaggggctctggagacccgggcctcccgctgtaggtggggccagtttcctcggagcgcctggaaaccgaaggcaggcaaaagagcacgggaccaaccctttgagtgtctgcagtgtgctacagtgctcgttcttgaagcagagaaactattccacccttcaggtgtgcagacatcagaagtcctacctccagggtggaagccggcctccaagttggaagtgcacagggctccggcagcggggtggcggggagttgggaagaatgcagatttccgggcccctgatgccgacctagtacacacagttccagcgtgcagttgggagtgcatgttaccggtaccccaggtgacccattatgagagttgaactgcccagaaacctgcctctggagggagtctggttcagcatctggtggagggcacccctgggaagcccatttccagccccttcccaggtgtgcagagcataagtaactggtgttcctcaagggagaagaggagcttgctgttgggggagaaaagagcatcttgcagaagggagaaacccaggcaggcctcagggatgactgagaaggcagggcacaaggtgatggctttgctgcagccgtgggctctgaggtgtccgtggtttgtgggcctctagcagcattgtggggtctctgcagtcagtgactgaggtcatgccgggccccgtactccattaggctcgggaaggtgcccccgccccacttcccgcatttccaggatccacagtaatttcatggcagagggtgaatatcacaaccaggaaggtggccagctgctctgtgctgttcctctatgtgaccagggaccggttcccagatctccctgcaacttggtgatgtctgccctgaccacctgcaaagtcttcagggacatgaggtcaagtatgtgaagaccctttgagaagtgcaagggtcagccttgactctggaggcacttgtggtcccttggccgtggctctgctctgattttccacccccactctctgaacagctgcatgctaagagctttctgtcctggttagctgtgtagcagtgtggtttcccactcccactcttccaggagttatcctgtggacacattggtctctgtcacatttaggtaattgttgatattataacaatgcgtaataacacaaaaccaagaaaaacatctttgcagctcgtgctactttattatttggccaattagaacttccgagtccagacctggaaagtttgctaagaggggcttaggggagcagcaagaccaggagcagattttcttggaacctgaggtgctttgatgcaggaattcaaggactcaccttcgataggtcaggctggggccctcttgagggcagactggttgcccagatcctgcctctggagagtcctgcgtgttgtcctgaatggggagacttggcaggcccccagcagaatggccacttggtctttcttggcagagagaccctgaatacatttctacctatttgttcccacagagaattgttttcaaaactgctctgtgccctgttttccctccagcgctggagtcaaaacatctctctgcatgctgggccctttctgggttctgggggtcccatggaaaggtgggcacagtggcgtgcccagccttccctcctgcagaacccgaggcatgtttgtggtcacctggccctgtttggggtggaggagggaagtagagtaagatcacattctgtcagccatttcctgtgataatttgggtggggttcacctgaaatttatctttacccactgaagcaaggatttgatcctgacagattattgcgacccctcccccagggcacactctggctttagagacttgtttccaagcacaccgccccttgggctccctgcaggtcctccctgatgctgctgcctgggaaagcagagcagagggcatctggcagagcagagggcatctgggtgggatctcctttacccagggcaaagccaggcttgttggtggcctgtgctttgttcagagacacacacaggccagtggctcagcacgcccacccctccctctcgtaccctcgctgtcccaggctgccagtggccctagttgtgaaactcctcaaacaatgcagaaatgtatgcagcatgggaggtgccagcctgcaccaccaccaaaccactgttaccccgcgttggtgtttttctttacagaccttctagatggatttgcacatatgcatatgtgtgtgtccacgtagacattttgaaacatacttaaataggatcctagcaagtatctcactgctggcattttgttccatgtgtttgcttaaatgaggcatcttcattctttttcacagccgcatggtattccaagatgtggttatatggctgcattgtaacttatttacccttcacttatggaaaggacagctacattgccttttttttgttttttctgctattacaagttgtgtagtagtggactctggtgtgtgtgtgtcttggtgcagaggagctggcatttctgtaggattgagacctagtggtggtattgacagggttgataagtgttggttaaatgtgttgtggagttactgtgttatgtttttcaaggaaagagaccacacttgttagtccccgctctgagggagagacctattgtgtcacgactccaccttcttgaaaatgtttccttctcccaattctccttttgcatgtgtgagaacattgagaacgtttaaaacagtaccagcaaaaccactgtcactcccgcacgcctggtggctggctctcttggccatcttcagttctggttttacagagattggaaagtgtgtggtgggcgctcagccctggagcagtaggatgggggctggtgtggcgccatctccactccccccttccccctcgctgaaagaaggctggaagctgtgctgcctgagcaaactgataggacgcagttcattaaaccagtagcctgtgtctggggcttcacatgtctggaacacagcagagatgggggcctgatccttctgagtaggtgccctgaagcccaattctcaagcttctgacagcctcctgcccttagatcctgtgtgctcccactttacacatagctttaatctgattggttactggggaagggcaaaagacatggatggcagctaaaggcaggggaagaaacaaaccagcaggttgttaacatatgcatgtgtaagtgtgtgtgtttaaatgggtcatgaagaagccctacagtcaaccagcactggaacaagcatggggccatttgtggagaggcacatgtttctccgcagcaatccctgaggtctgcatgagagaccctggaataatgaacactctagcagggatcttgagataccatggcactgtgaagtgtgttcagtttgtgctttcaggaagcaattaaaatagttttaaaaataaaaacttctagaatagtacactcaactttcacaatcctaagacttccagactgtttgctctaggggccaggcatcattctgtttgtgttagtttacatcaagctatctaatcttcacaaggaccctatgaagtaggctctattattaatactaaatttcaaataaggaagctaaggctccagtgctttaggaatcatgcccaaggtcacacagtaagtgagggtggaacagggattggagctggggcttgagcctgggcagccgcccccgaggtgggtgtacctgctgtgtcctactgccactcctgtctggaccagtgtttcaggtcactgcaggtgagcagggccctgtggtagtagaaatctggatgtccccagcacacggcttcccgcacagatttttgctgcttcttaaaggttgagggagtagtatagtgaacactcctatactcttcccatagggtcattgggtaatattttgccacatttttctcctttcctccttctctttttctttctaaagaaagaaaaattaattttttgtctatatttttctcccttttccatctcgcctctctctttaaatattatatattatctgatacgcagtccatattcagttcccctagtgattcctaaaatgtccagtataggattcaggatccagttaatcacacattgcatttggttgtcctctctagtttcccttagtttaggatagtttcccatcttttggtcctttattatgttacgctggcatttgaaggcccaaagccagttgtcttgtagaacaactcacaatgtggattggtctgattgtttcccgtgatcaggtctggtttaaacaaattttggtccaaaatatggcacaggtgatactgggcacttccatcgcctcatgggggggggagggcatgggatattagcctgtcctactgcaggatcacatggttaaggtgggcggccaggctcagccccttctgtccacctggttggtttctactccatcttccagcttccttgactggagagatgttgggggttgggttcagctttggaaggcttttgaagtcaaaggaccacctggaggaggcctaggtgctcctttccccaaacagacaagacaccctgattttcttttgaatgaaaatggctccagatggtattaatagccagctcaagggtaactgtgagtgtgttcttggtcagcccacctgaatgccggccctgtggccacaggcagcctgtctcctagggctggggagggcctacggcgggtgacactctctaagtcctggtgagtctttatgtgctttcaagaaataaacaaaaattgtcctaagtccacacacctgaacctgtttttcttttctttctttcttttttttttttgagacgaagtcttgctcttgtcccccaggctggagtgcaatggcacaatctcggctcactgcaacctccgcctcccgggttcaagtgattctcctgcctcagcctcccaagtagctgggattacaggcgcctgccaccgtgcccagctaatttttgtatttttagtagagacggggtttcaccatgttggccaggctggtttcgaactcctgacctcaggtgatctgcccacctcggcctcccaaagtgctgggattacaggcatgagccaccacacccgaccttttctttcctttcaaagccccaaatgggattattttcttgagaagtcaacttcctgtcgagatgggaataaacttttctccagcttggcaattcagaagcagccactgtgctgtgtggctgaggttggggtcatggagacagccaccagtgcagtcctcggggtgggagatactgagttcagaaggctttggacactcttctgggccaaaataacagaaactcgaacttgttttactcttggcatcaatcgggcactgggcacagaagaaatcctcacccaaccaaaagctctgccatttggccataaacacgtatgcctccatagccacgtacatgtgtagaaacacatatgggtgtgtgtgtgagtggacgtggcaccctgctcatgcttgctgaatgggggagcatccacacctggaacatagtggctatgtggaacttctgatttctagttcagttttagatcttaggtccgtcttcatccccagcaaatgttaccagctgtttgtgaggcaggcttttgggggagacatgaagtttgttcagttgaaactagggctgtggtgaaggggctatgccttcacaccctgctgccctgcccagcagagtgaccggctcctgtgtcctccacactgcttcagttcccctcctgatgcagggccaggctgtgatcgccatttgctgttgggcattgtgtgtgtgtgtatgtgtgtgtgtgtgtgtgtgtgtgtgtgtgtgtgtgtgtgtatggtggcggggcagggggcggggggagggcacagcatggcaccgagcaccagaaacacagccttgaccagtccctggtttttaccaacatctttctggacaaacaagacagcacacttggcagggggagtattctgtttattgttctccatttttgaagttcatcacacaaaaacacttgctaaccagaaacttggctgcactccgtggccattggccagtctgtcccaaggtgacttgtttggggaagcactgaagcttgatgtctcagattaaatgtccttatgctggtgccacaggggtgtggcctactctgcatggatgggtgaccctgggtccccaggcacagggcacaggctcgtctccttgaagctggagcccacgctgcatcatgaaagagctctgcaagaattgaaggcccagagcaaaaatcgcttaccaaagagcatgtggctcagagcctaccttggcctcctgtctcaggagaaacttctaaaggtggagttgtgtcacgtgcttgtctcctgtgagcacaggccaggtgggaggaagcttgggagtggggagaggatgacgtgggctcagaggagccacgagcttctcccccgaccccagcgtacactggacacacatgggaggtgaggtgatgcctgagcagcctggcgagtggtcagggccctgggtggggcctcctcattcccttttggagcactggcagctaatgcttgggggggccaccatcctttcccggtctggcctcgttgggggacacatctgtcttcctcctggagtaaggagagcctgtgaacaaagcagtgaccccaagacctatggccactggggatggcaggagccttgtgcttccatatgtgggtccaagctgtggatggggaggccaagtgtcctggcatgtgggaggtggtcaggtgctccctggagatctaacaggtatgcatgggttagcgagacctgagagtccttcttgggccacacctaagtatgtgcagggcctgtgatacagccagaatttcctcctctgataaacttctctgagcctttctacttgtctttaacccttttattgtctaaatgctcactaaacaagaaaaataatacagggaacttggtttaggggtattggtagaagttaaagttgatggcagagcatgaataggggtgtctgcaaggaattgttggaaaagagattggaaatagagcgaaggcgtatgtgagtctcagaacctgactcctttgttgactgggagtggggcagagggcatgggtccagcaggtcattggtctcgggttaccaaaaaggttaaggctattcacctgggccactggctggggtgctgctcaaagccaggatctgggagccggggtcagcaccttgggtgcacctgggcatcatagcaacaacaaaccccaacacattttcagggaccagggcggataaatgggagttaatgacatggttcccacacatccgaatctgggatatgtaaatgtgacacacagtctgagcatttggcaggctctccatggtcttgctttgcatagtttggcctatctgctctccagacttactgccccgttgtcctcacctgcatgactgtccatgtctggtttgtttactcgtcattgaaggcatccacaggggtgccatctgcccccatgtccctctcccactaggcatgctaagtggcctgcggcagggcaggcagggactcagattccctccatcccatcgctgaggtcttacttccttcttccgcccgccttacacgtggaaggtttctcctgtgcttgtccaccagttgttgtttttgtcttctagcacggatggtgtggcagaaggaggccttggacagcagcacgttaggacccacaggggctctggccccttgcagctgtgtgttctgagggaagatgcccaaggttttattatcttttccagagcgccctttttttctgcttgcatggcaggccctttctaaaattacagtcataggttgcttaatgacgggtgcgttctgagaagtgtgttgttaggcagtttcgtccttatgtgaacatcatagaatgcacttactatgcacacctaaatggcatagcctactgcacacctaggctgtatggtgtagcctcttgcttctaggctgcaagccggtacagtatagtactgtcctgaatactgtaggcaactgtaacacaatggtaagcattttgtatctaaatatagaaaaaggtacaattaaaatggggtgtcgtcttatgggaccagcctctcgtcccacgtggactgtcattgtttgaaacgtcattatgtggtgcatgactgtactttgctgcttggcctaaggtgccagggcattctctgggtaagcctgaggggctttgcaggataccatcttttatcaaggttgaaattagttttagcactttattctgtgtcccctttgcggctgacagagcaggagcctgtcagtgtctactgtcacaggtgtagagctgctgtgttggcgagcaggtaggtggttttcctgaattactgtcaggctttagagtcttacaggaaatacagccttggctacttatagcttgtgatttgaagtttccctaatgatgggctgggtagtacacttcagcagtttgctttggacaaattgtatcattcttaagttcactcactttagcctttgagaaatttcaaagtttgtttccctgatcttcctagttgccctggattatgagccaagcgtttgaattcctttgcacatctagcactgcacatggccttggaagatggacatttatgtgagtgtgtgcacgtgtatgtgtatgtgtgtgtgtatatatgcccgtatttgcagcatgtgtgtatgtgcttgtatatgcgcatgcacacgtggtcagccatgcagccaagtctcagaacaatcgttccactggaagtaacccagtcttgaggcatctggccaggtggtgcgggctgcagcacaatgtttgtttctcccagccctatgaaccccagtggggctgcatcacttaaaggccggtctctacaagagcagggtaggaagcagcagtgcgtgcccagccgtggctgtgtaggcagaaccagccttcaggatggagggtgggaccctggagccaagccagagggtgtgtacccttggtccctgatgaggtactccatcttgggccattctgccccctggtctctctgctcctcctctgcaaaccaggggggccagcagcctgctgggatcctggccctggccgggttaatggatgggaactgagctccttggctgccaagctgaggttcagtctggccccattctcacttcctctactcccccttgtactgtgggatctgagcatttctttaacagccttcaggggtttccagcccttaggacaagcagcaggtgggtatacaggggagcagaccccaggggggcctgaggagggagggtgaaggcaccccttctttgtgctgtctgtagctgctcatcctgggagacactgtgggggaggctgtggcttccttcttccgccctctggggatgccctggcggcctgtcccttgggtgttgggaggaggtggcttggctgactgtccctgctcatggtcagggtcctcctacacagcagaactggaggtaaacactgggttgccttggcaactgggctgtgccatggctccaagtgctcctggctagagaagttcccattgtctcaagtttctaggatgggtttctattttgatttttttttttttaaattagcaagaatgactaagataccaaaatgtctgacctggtttctataatttcttaataaacatttgtcttccctttataggaggaatgttttagtgattcattgacttttcttttagacggtggcaaggccctggtgaggcagtgcgggggcagcacagaggaccccccactgccgacagctggcacgggaggctgggagagcactggccacgatccagggaccaggcatgcttacgtagacaccacacgaggattttattggctttgaggctaattaagttccatggaaaattttggggagatgcctctcccctgtggggggttcagatacccacaactggtgcttccagaagctgtctgaaggctgatgcgtctgactgagcccgaggagcgccctcccacccagtgctgcactctcccgccagaggcctggccccctccctgcaggtcagggcatgtgcttgtttataccttgttggtgtttgctgttaaattctaactgctcacctaggtagcctgggctggctgcgcccagtggatgtcctcccgccccccgcctgctgtctcgtgggagtgccccaggtggcactttgctgtgggagatgcagcagcgggctctcgtgcaggcctgacccttcaccttggatttcactgggcttccctgctctgcccacccatggattatcttgtaaagagtcacctgccccatggaggagccaggtgaggatccagggaagtggctttgtttattttactgtcagtagggctgacccaggttgccctggtgggtggtgtgtcctgtgagcctctctgcctctaggcctgtttccagggtctcgtcttcgttgtaggcctgcaggtctatttgggtcccttctcacgactgaggcaggctgaggatgtacccagttgggctgggctgccttgtgggtcctctctccactgccctcatggccaacctcaggcgtgaacctgcctacaaagcctctctgtgcagcagcagctgtggcagttgccaagggagctcagcaccaaaaaagatgttcagatttgctgcatttgttttggaatgagtgcctggtgttgcttgtgcacaccccaagcctcctggcctttccaggtttccctgttgaacaggcagctctcctgcggttgggtggcacagggctgtggtgagggccccagcatccctcctcacctgggtgctcagttcctttcttgtcatcctttctctgtttgtaaagcagaaacagtcctgctaacatcacccccttcaaagatgtatgcagaatttgattttttttcctggaaaatatacttttttagtgtttaagaaaaaactcgtgctgggcatggtagctcatgcctgtaatcccagcactttgggaggctgaggcaggagaattgcttgagcccagaagttcgagaccagcttgggcaacatagtgagactccactgggcatggtggtgcacacacctgtaccagctgctcaggagcctgcaggcaggaggatcacttgagcccaggaggtggcagctgcagtgagccacgatcttgccactacactcaaacctgggcgacacggggagatcctatcttaaaaacaaaagaaaaaaatctcaagtcaaaggtattgaaatagtattggaaagtgttaaaggagtccaaaacatgagcacacttgggagtttcacgggagacccagcgcccctgtgccctgtgttcatcctgacaatttgggctctggacctggagccccgagacattgctgtgtctctcttattggatcgcctcatggaagcttgactccacaaatgttgtatttgcatgaccttccttgggaggctctcagtgttttatttttcatcagagaaaggccttcttgtctgttggttctttgttatctaaacagaggcactgtggtgtagtgatgaggagccctggcctcagagtgggacaggctgagcccatctctgggttttcactgtgaagtgggtctggtcatgctgcctctaggagcagaggggtagaatgtgggtgaggcacccagtaggaggggtgtgtgtgcgtgtgtgttcacgtgtgtgtacgtgtgtgtgtcgggtaagtggtgattaacttgcaagagcaaaatttcaccccctgcagtattgttcatgggtacctaaatgaacagacaggtttgctgtcttctcttttgaaaagaaacagacacatagacaattcagaatctttttttttttttttgaggctgggacaattcagaactttttttttttttttttgaggctgggtctcagtctgtcacccaggctggagtgcagtggtgcgatcatggctcaccacagcctcaaactcctgggctcacactatcttcacagctcagcctgccaaagtgctgggactccaggtgtgagccaccacacccagcccagaactactgttttaaagcaggtgctgggtcactttccaggatcctcacagcctgacctgagccccccttcccagagtcaccctgtgacacagcatgtggggtgatgctcctggcatcccagccccaggcgcatccagcctcagcttctgcgtctgtatcctcctggataaacccagactggctgcagaaaagtggtacagcctgtgagcttctgtgagcatcctgttgttgctatggagaccctgttgctagacatcaggcatgctcagactagggagtggtgaccctgtctcaggtgagcctcacgtgttaccaggtaaccaacccctctcaggtaccaacaggctgtacctggctagactctttaattagcagaagtagatgaactgaaacctcaacctcaaggtgaaagactcagtcaccagtcatcagaacagttctggacaagtccacctctctgaggtgggcttgaaagttgccctgcaccctgtgtcagtagtcttgggcagtcttacagggacaggagagattgtgcctgcaggtggccatgctagtcctgccgagtgaccccaccccaaggaaaggactttcggagaccaggcattctctgggtgagactccccacactgggcagtcttgggtgaggatgccggctgccctcccagggacgcagtgccctgctgggtgccccgccttccctcctgagacccaggcaccatgacaggtttcttaactgacagctctttagtagagaacagaaatcctgtttgcagcaaaacttgcctcactggatcgcttcataacagctccttcaagtggggcgagctcatcgctgcggtcggcatctcagccatcagcagcccggagaatcccactcaggacttaggtttgctatttttgtgtctcgcctgggcttcgctcgtttccacaggcattccacttcttgtttacaggagtaattgccttcatgagctttgggccatctgcggatatatgtatttttttctttattttctttcttttttggggcagcagttctatgtttgcaaatatgaggattgtttcctaaagggaagcatgaggccttcttgaggctggcctcttggctgctgagctgggccttcgcacccctttcctgctttatttccgtcttcctgtgagtgtattttgttgtatagaggcgcttcctgtggtcggaggtgaacatttggagtgactaaggagagcatggccttcctcgctctcccggcgtctgattgctccgtggacacttgtgcctgttccccaggcagggcctgcttgctggagggggtcggggccactcctggccatggagtttccgcatccccctgctggccaggctcctgtgcttggggagaggaggacgccgaggcacatactgtctccgtgctctgctcttgtggtcatgagtggcctcttctctcttctgctttgagtgactgggtgtagagtggcgcctgagctggggactgtcttgcacccttgcacagggcccgccggctcaggtgtgcagcagacaccatcctgggagaaacagcagcaaggtctggggtggccacatttgcatgttctgcagaggcagttgccttcgggatttcagacttgcccccagccgtaaggcgggatgcagtgcccacagacaaggctgggtgcacacagcctcccaaacagcatcctgcagtcttaagtctgcacacctcccaccaggtgtcggcccccagcagtgggaaggagaccagccttcaggctgctcacctgaagggagaaggcaaggaggcatgaggggtgcatccagcctccagtggggacccacaggtggcctgggtgctgatgggccctggcagagtctgtgtgcccacccatgccgtcagtctcctgaaccgcaggagcaagaactggatttcatgttaggagatgatttccaacttcaagaaatgacctggaaaagttttctacttaaactgcctgttgttgttaagagctggccagctctggctttccaacagcacgcacagccctcgggccaggctgagtcctgatgtggggatgtgcccactgactgcgggtcaccatgactccatggggaaggtctccttggagaggtctgaggctctggtgcacgaattaacctgctccttagtcttccctgggagacctcttgatctcctgtccccacccatacttctggtcacttgtcagtctttgtataatgtgttcagtgtccctccctctgagacggcagcagagacaggagagccacgcattgcaagtggcccatgcctggttgctgccctaaatacttgctgtgcacaaatggcctggctgtcaggggtgactttggccctgggggatgttttccaaccccctgggacaaacacctgccaatacttagcagctacctcctgctagcgctgcgcacccacaccaccctgagcctgtcactccagctccagaggtggggctctccccacacccatacccatctctgtgcagatgcagacatcccagatccacccctccagcctgtgtcaggaggggagtgggcacctaggctttcccctctttgtggcaggactggaggagtgtcagcagagtggcctccttcacctgccttttaagccagggcgtgctctgaaaacacgccatggctggacgttttcatgtgtctggctggcaagggctccaggggaggtggcaggggtgccaggaatccccagccacccagacatttgccaagcttggctcctcagtgccttggctggtggcctttgggggtgacttcaccctactgtcatggctggcccatggcgaaagggttcacctgctgcttaggagctgagactgggctgggccaggccaggggccctgtttctcttctggactgtgggggtttgggccagtggggagggagagcttccccaagggaccattacagaatttgctgtaagaatgtggagaaggagttctggtccttgggtttacagatttttattctaaacctaatggaacctttcttttaacaaaatctcctggaatccagtgcagaaaagagctgggaggattgctgggtggggcaggatgagggtgggaggggttttgactttgtcctgaggctgtgcgggatcctccctgggtcccccaaggaagccgcctgagtggggagggaggggccgcaagtaaccaggagcaggccaaggttccagggttcagcccaggacagccagtctaggtgcaagccaaccctgggggctggccagggagtgtgagctgttgcagtttggggcaggtgccttccaggctctgtgggtcagggttctctcctggcccttctgagggtgccaccctggcctccccgcctttgagcaggtgggggttgggtctgggttccatagggctgggcaggaggaggcagctgtgagatcccaggcagagccaggagaggagcaggacagatggcatgcaggcgtgctgcatcgggctgggattgtggggtgccagcagacaggggtggagtggggacttgggcattcctcactcattgcctgagtgtcatgaggggcctggctttggctggtgtttctgtcccttgagggcgtggtgtctgagggcagggcctgtggctccaccctgtgtgctgctctgggggcctggaggcctgtgcccccgcctcagcctgcctttgccctgctgcaccgctggcctgcctctttcccattcgggcacctgcctggagagcactggggtgcgggcagatcctgccttgagtgagcaccgcgtgcctagcagcaagcagcaggggatctccaggagcgtggcagggtcccatcctgaaactgacaggaaatctgtgagtatgagggtgggacggagaaagcccgggaggtgtaccgttcctttggcccccatccccctcaccaggggaccctgccctactcactgtcttccagtggccctacatgggcagcatcctgcctggctgttgtggttgtgaggccgcagcctgagactgaccacaccagggcttagtgtgcttagttctgacccgggtgtctgccctgccagcctggtgtaaagtcgtcagatgctgtgggccacacgaggtcatatttgcaccgtcagtttaccgggggcaaatgaccttctggggagggctgcaactgctccccacctctcacccctggttgtctctgtttcccggagggttccgtttgtaggcactgatgggggttctggttctagaggaagagtatctgagctcagagggagtgcagctccacaagtgtgcccctctgtgccggcatctggctcaggcatgcgtgagcccctctgtacagatgcctgcctcacgctgagatgcccacggcccaggcatatctctcaggagcccccgagaaccctgacgggaacccagagctgttccgcacagaacaccaggtcaatgatcttgactctgtttctgggaagattacccatctgtggcttccagaaagcacctcttcgtttttctgaaactcacagccttctcccccgacctcctgtcctctgcttttctctgaggccagaaggagagatttccacaccggccctttgccctggccacaggcctgagctcctgcatagcagctgctgtccttccccttctggactagtccactctaacctgaccctttggtaaagagtatgatggaccccccaccgctgttaccagtattcagccaccctggagctgcggccacccacacagctgtggaaagcccccaggccacagccaggcaggagctcctccccgggttctcttcttcctctgcaggagcttccaggccagagccccaaggcctcatgctgccccctgccccagctttctcaggacatgaggcgtcccctccttgcaggccccccaggctgacttctgtgtcacacagcagccttcacttccgtatctttctttctcttttaaaggcatcaccttcaactggaagaagaaatgaaaataccacctgtgcctcgaaatctttcagtttctagcgagggacatcccaggcacttggtggtggggccagggctcctgccggccataggtgggctattggcctgcaggccaggttcctgcctgccaccactctgcacccctctgtgctggcggcatcagggagggtctggggagatgcagactggacgtgtgggttgggtgggccagcaggggagaggggcagcgtagggtcctgagtctgggggcaggagcagactgtggtagcaagcatgggtgaggacctcagttcccctacctgctggctctcatcggggctgggacaaggtcaggtctgtgacagggcacgacaccgagcccagcaggtaggaggatttgaggacctgtgaagctagaaggtcaagcagggaattcaggatttggacaccctcctgggatcagcaggcgttcccccctccattgctctgctggtagcaccagccttcccagaaaaaggcttctttggcagggcctgggaacctcctggagggagctgggtgaccagcttctctgctgagccccactgggacagcacacctcaggaagaggccgtccttggtgctcgtggtggggaaggggagctgtgaacaaggcttccccctgaggcagggctggggatgggcagtggagactggaggcagggaagagctacccaggctttgccgcacgtgggtggcaagcccgctagaacctgtgtgtgctagcgtcaaagggcaccctcagggggctgggctggggaggggccccaccttgactgtggtgatgagagaggcaggatgtggggcccaggaggtgactctgccttggaggtgctgctcatgagggacgagggcatcctatggcaggccctaagccagcggagcctcagagtaggggagagaggcggggcagtgtgacttgggaagccaaggcaagaaatggctaaaggaaaagtgggtgtcacagtggctgggcccaaaggctcccatcctgccatcctgtggcagcagcttgagggggccccaacctcttctgtctgcccttccaccccctccagcctctggggccctggggcagcatataggctgcaggggttgggggctgcctctgttgtagtggctgcagcgctggtggaacaggaaggtgtgttgttggcttctcctggaccacaccccctgaaggtgacaccctcctaacacgaggaagagagctgcgcttctcagtgcgttccagatctcaggcttcagtgtctccagcctggccttcttggccactccacatgagtctgcctcagtgtggaggcttcttcctgcactttcaggggggtttatttctgaaggcggaaggcaggcctcgaaccccaggtgttcttgctggtggaggaaagtggaaaacacgcaggctttgtgggaagaaaggacgccactcctcctcccgtggattgcctgtggagctgggacaggcagcttgccactcttgtcaggatgactgtggaaggtgatgtctagaagagagagcaggagcacaggcgcccctcttcagcttggttttgcactaaagggacagcagaacccagagggcctggctctgtcagcccagcctccagtgccttccgaaaggaaaaaccacgcgtggtacgtaggcacacacgcacgccgcaccacatgctttttattgaagtatacgtgtgctacagaccatttaagtacagaaaagctaaaagaagaaattaagtggcacccacagttttacctcccagacaggactgttgcttggcctggttctcactgaaaagctgccagcatagagcccaggaagcccctcctggcagccaagggtgtgaccctgcagtcacggcagcctgcctgctctggccactgatgtccgcattttttagaccctggggtcctgactgcatctcaggccgcagtgccttgggctccagtggggtgtctcggtgctggcattgtagagtttaagcaccgccccagagctgtggtggaggctcagtgtgctgctgtaacagaaatactggagatgggtggcaaataaacaacaagtttattttcatagttctggaggctggaagtccaagattaaggcgctggcagattattctgtatctggtgaggaccctcttcctggttcgtagacagctgtcttcttactataatgtcacatagtagagggagcaaagggattttctggggtctcctttctaagggtactaatcccataaggagggccctacagcctcatgacattatcaccttccagaggccccaattcctaagaccatccatcaagctgggagttagggcttcagggtatgggttttcaggaggcacaaacattcagcctatagtgcccagcgttcttgcctaaccacggaaggcagatggcgaggtagggtggggtactgtatcctctgcaggcctactcccccaactcatggcagcttttttgccccttaactttgtagggccgaagcctgtgactgtcattccatctgggggaatcccaggacccagggcaatgctgctgctgcccatttagggaggggaggctgacactgctttccccatgagccgccacctgtgcagattatgacatgtttccccagagtgtgggatggaccaatgcccgctgggccacatgggaggcgggtgccctgtcaggcagtagtggtacagcagcgctgtcttcgatggaacagccaccatgccgaggacctggggatctggagggcacttgcctcgttctgcactgacccttaacatgagtctctgggacccagtctgctccagctggtgccagcctgtggttagtcagcttgcctctgatacttcactgccctggctgcatgagtgcaagggcagtgctgtgttcttagtgcctagcatgcagtggggaggaattaggctggtgtctgcaggagaagtcctccgggcccatgtgaggcgagtatgggccaagcctgtgcccctgtgcctgtgacccaggctgggagcagggggcttcaggtcctcaggctgctttaagcctgtttctcctgggcctggagggcttcctggggagggggttcacagcttccaggtcccctcctgccactttgaacttgggtgtgaattaatgaaaagcagatgagctcagatgtccctggaattccacatgaagttgaatggtataaagtaaccagccatgtgttcttggcggaaccaaaagtactcagagtgttgctgaagctgccaagtcctcagagtagcctagcctttgccgaatttgtgcttcatgggatgaatcccatttcatgagatgatgtgcttttctccattgagtgaagccctagagaaaatggcccctaaccctcggccattccagacatggagagtagtacagcatgcggcccctgcttttaagccaatatgcccattacagggcaggaagcagccagggtctgccgcagttatggtaggatattgggcatcctggacccacggatcctggacagaaggatgaagctttgggattggggagggaggggatgagccgagcaggccccccagcgtgcagggcacctggatgccgaccacattggtccgttgttcggaacctcgccttagctctcttctgccagggcctaatgagaacaatggtctctcagctgagcaggtggacacctgtgaacttcatctcattacagatctcaaaggagggagtctatgtggttctgggcaaggatgctccactttgcttccgtcttcaccaaactcttaaaatatgaagtgtaggaaattatgcccctgcagggttcaggataaaggaaatgacacccaagccttggttctttgtacctgttccatccactgggtatttagagaaagtagcttggcgtgtaaggtggtctctggcccaacttcacccccttttttggtgaagtctgggacttgcacaagcactggctctttggctcagctttcagaccttgaaggatccgcaaggaagctttggtctgggtacagcccttgagaagggccttagaggtggccatgccagtggagaaggtgaggctaagcaggctcttgaggtgcgcccatggccaggccagaatgcaggcctggcactcttcgcccaggcgccttctgggcagcagcagttttgagtaagtaaggagcctaatgtttaatggcctttgtgtaagaacatgatgatgacagcgagagcagggaggctgggagggagtgtgtggatggacatccgagtaagagttccccagtgtctccaggaaccacttgctttgtaaaatgacccaaatccaccatccctggacctggcgcagattctgagttgggccaaggcctgggaaacctgagttggaaagtcttttctcagcccgtatcatggacttgcttttggtgctctgggctggggtcagatttgtaagtgtgttcctgttgtaagaagttgccttgccaaaagatcatcatttgagtgcctggcatttgtttttatttctatttgtgaaagtcaagcatgttaattaaggatgatttgagaaacaggaaagtatcaaggaaaattaatgaagaggaaaatcaataactttaatcccaccactcacaagtcaccactgttaaaacgtgggatcattccatacaagtcattttctgttctacattttcctgctttaacatcctgttaggctcataaccccaaggcactgactggtttctaacctggtctgagtggttgccccgtgtgcgcttgtcttgcactgagagctccagtgattggctgtcctgggacagccgtccacctcattattttcagggggagttcccaggagcctgcaaaggaatgtgcattttcagggcaggttgcttcttttcagaaaggaaggatgagtgtgctacccgcaagcaaggcatgagagcgcccaggtatgcaccctggcagggagagtgggcgggtggctgttggatgtctaaaagggttttgcacaccgggcgcggtggctcatgcctataatcccagcactttgggaggctgaggtgggcagatcttgaggtcaggagttcaagactactggcctggccaacatggtgaaacactgtctctactaaaaatacaaaaattagctgggtgtggtggcggacgcctgtaatcccagctactgaggaggctgaggcagagaattgcttgaacccaggaggtggaggttgcagtgagctgagatcacgccactgcactccagcctgagcaacagagtgagactccgtgtcaaaaaaaaaaaagggaggcggggggagttttgcagtgaacagaagtcactgtttaagtagagtttacacacaacaacaaaaaaagggttttgcagtgaacaaaagtcactgttggagtttacacaacagaggggtcgccacgctgccccgtacctgggagcttcagactgttccgaataggcctcccctggacactgagatcttggaggctttgtgatccagccttggatgccgggtcctgagatcttgcagtccagggaaaggtgagattgtctcacagcagaggcttgcctgctgcaggccacgctcaggggtttctacctccctcagtcccagtgtctgccctacaggctcccttggtcccgctcagaatgcacagacctgaccgtaccagtgagaaaggacaggctgtgtgagctctgcctggcccaggtgtgggctggccacgggctccatgcctgccttctccatgggccatgacgtcggccagcagcctcagcagctgctgagattagcgtctgtatgtggtgccacttggtgtgcctctggctcctggccctgtgctggccccgtggaagggcctgtcagcatgtactctctcctggggacaggagcagtatcttcagggctgggtctaccaacccggtctgtgcatttccagcctcctgtgtgcttcccagctctgaattatgaccactgggctgatttatttcttctgacatttgcaagctgttaggtggcagagatcagtgaataaaaacttaataaaaggctgtatttaatcccatgcatcctaggctgagccaagttcccttaggattgagcatcaccagatagaacccagagcccactggcattgggacctccagggtggctacttggagtttttgtggggagggcagtttcttgaccgtggagcatgacgaggctggacccacctccccgtctgtatgcagccaccatgcagcccacctaggctgtgggctctgttgatgccgccttggagtgtgcggcttgctctgggtgggccttccaggggaggagggactgcagaggtagtgacagggaagggaccctgggccagggggctgggctcaagggtggctccacatctgactttgtggcctcatttcctggtctgtcacttagggagttttgctggggcctgttaaagggggagtgcctggaggtatcaaagcaggggcttgtggccctggtcatccagtagttactgggggtgtttacagccgcctgtgctgggcctcccctggagaggaagtcacgcccacgttaagtgcgtgggaaacctgtcccaggcgttctgtaaccgtagctgcaggtgctctgggtgttgcctcctggctgtagagggcccccttgtgaagaggggagccccaggttggggggcctgggctggcaaagtccctgccatctggcctgcccacttggggctggctgtgttgggcctggtcccaccagggcttgggctgcttccagatctgttttcattttcaattccctttattgctataaaaccacttcggggctgcagagaacaagctgttgtcctcagctgacctcagattcctggcctcaattgtttgcctcttgctaattttagcttctgatcatttccactcttatcctccccccaaagggagacacagaccaagaatagctgctgggaaggggggctgtggtggctgtggccagagttccaacagtgagctggcagggctgtggagtggctcgctgtggccaagcctggggcagggggctctcggcaggcaacccccacacccttcccctctctcaccgaggactctatactgcaggcatgggcctcagaggagaagaggacttcactgttccttcttttaaacagaaaccaggctgcttctggggaaaaagtacacccccacagccctgcctagcttgaagacccctgagagtccctaactcccctgagcccttcagactccaggacccaggttgtagtgtggggtcagacgtggcacttgactacagccaggccctggatacagcgtcagtgtggaggcctcaggcctatccaatccctacccagcttggccccagagcctggcacagctctgccctcccagtgagtgtcaggctgcagttgactgacagcaatgtccagtccaggacatcagcccaggcctgcaggatgggactttgcctgcctggggcagggagagaagcagctgaccaaaccccaaaccgtggtgtgctggtgagcaggcctggggagagccagaggagggatgggctgaaatccagcgaggaggaatggcctccaggcagggcctagggttgcaatccttgtccatatattaatagttttgtaatttttgtttttgtttttgagacagagttacactcctgttgcccaggctggagtgcaatggcgcgatctcagctcactgcaacctctgcctcccgcgttcaagcaattctcctgcctcagcctctcaagtagctgggattacaggcacccaccaccacacccagctaattttttgtatttttagtagagatggggtttcaccgaaatgttggccgggctggtcttgaactcttgacttcaagtgatctgcccaccttggcctcccaaagtgctgggattacaggcgtgagccactgcacctggtcatattaatagtttttaaacttctgtttggagaacttcagacagatgcccacatcttcaggacacccacattttcagcacctgctagccccctgcagtcttatctctgcccctcccccaccaccgtcctctccagttgttttgaaggaaatcccagatgcaatatcaatttgtccataaatatttcagtgccttacatcttcaaatgaaagcctgatacgtctaattttcatactgggctaacagtaagtgtgaagcaaaaaatccaaagcctgaagtcaccccacatgacttggtattgggaattgtgtggatccagccctaaaacccccgggcttggggttggagccaccatttaaagaagtgttggagcccatctcgccatccctcagcctcgagttataactagtcataggtaaaaagaaggcaaccaggacacaggtgtttatgagatcaaaagcaacaacaaccgaaacaatcaacagtgctactaaggtaacacagataggtgaggaagaggccaggtgctcagtaagtgtctcctgtggacggtccctcacctcccctgagcagaagggcagggtgtcatctccacatgccttggggagatggcagggccagcactctccaatggcttctgaagaggagctactaggagaagaaagtgatgctctaaggaaaggctggactgccgagagcagtatacccatcccattttgtaaattatgttaaaaattgtgttagagtagtgcatgtggtaatacacatagcttaaggatcctgtctttctgtacgttcattgtgataagcaggtcacccccaccatctgccagcttcttcagctactgcctttggtatttacctttcccagctcgataacgtgctcataggggctcttcttgatggtagaagagtgttaggcattatctcctgacttcccatgatggcacatgagcgcctgcaggcacccttctcccacccatgtgataattggatatttaggatggagccagcatgcggtattttgggggatcatgacagtaaatgctagttgcaggtgacccatacattacacgtgtttctttcccttagactcaatagttgccatttctgcttggttttcccagtgctgttgtccccacacccccagccccccatttgtccccacacacccagtgtggcctgctccgtgtggcctggataacatctctgtgggggttggctgtcatcctgggacccctcccctaccatccaggccccacttcctggagcccctgccatctgcttcttggcagagctcctgctgcatagcctcctggaaggggtgcactggaggccatttttcctttccttctgacttttattttagggttgggggtacatgtgcaggtttgttacatgggtaaattgcatgtcacggggtttgatgttcttatttcatcacccaggtgataaacatagtacccgataggtagtttttcagtctttcaccctcctccctccccgctcaagtaggacctggtgtctgctgttccctcttttgtgtccctgtgtactcagtgtgtagctcccacttataagtgagaactggccgggcgcggtggctcacacctataatcccagcactttgggaggccaaggtgaatggatcacctgaggtcaggagtttcagaccagcctgaccaacatggtgaaaccctgtctctactaaaatacaaaattagctgggcgtggtggcgggcgcctgtaatcccagctactcaggagactgaggcaggagactcgcttgaacccgggagacagaggtttcaatgagccaagatcgcgccactgcactccagcctgggcgacagagcgagactccgtctcaaaaaataagtgagaacatgcagtgtttggttttctgttcctgcgttaattcacttaggagaatgggaggccattgttttaaggcttatatgtctggaaatgtcttgatcctggtctgaggttgattcacgtttctctgggttgaatcataggtgggaatggtttactcgtgcggtttggagctctgatgttgctgtggagaagactgaagcttttctgattctggctgtgtgcacctcccggtctctttgcctctcagggccttttgggcttgtgcctttaccagggcttggaggtgtgcacgtgtgtggaggtgcttggccaagctctgtcctctgcagcgggcccgtcgggtggcatctggaaaacattcttgccactttcttcacgatcacctcacctcctgtgttctcagggctgcctgcagttccttttatttggagctgttggtctgatccttacattttcatattttttccctcttacccatccatttgtatttttgctctgttttctgtgaaattctctcagtgttctctcccaaccctgctattgggatttttatttctgccacatttttccttctgtatctttactttcagactcaggtttctaagcctttgctttcaaactcaggtttctaagcttcccttttaaaggcacatgcggttcttgtttccgccaggccgtctatgcggtgaggatgttagtgacagctctggaagtcttctcgttgcgtggcctctgctccctccacatcacctgtctctgctccttggtctgggtctcttgcccacccacgtcaggctcttctgcattgtctgctgatccttgatgtctggtgacacggcccagagagcctcgagctgcgtgggggcttctgggtgcccatcaggctcagcgacggtggcctcctgtgggtggtctactgggccatctccttccgggttttcccccaagaggagtgttctgctcctgcctgggggagggagggtggtcctgctgcacactgggagagaagctgggaggcagcactctgtgagtgggctgttccccacacccctgttctggaggctgccctactctgagctgggtctggagtcgtcagtccagagctccctcctgtgtagaccctcccagaaagtcagcctctggttcctggcaggtgcaggaagggcaagcagccatctgtaaggtgaggaaagaccttgtgtccacagctgctttatctgatgttcaggtgccccccaccaactgcacccccacccccgccagagactcccgagcctttgtggggaaacgtggattgcttccttgccttctctgctgtctttctaatttcttgcttccagattatttttgttactctctttcccttttgctttgtctgttaaaatccactttctttcattgtagtgggatctggggctggaagggtggtgggtgcctgtgcctgacctgccagctttatccagagttcctgttaggcctttggtccagtgcaggaggcgtggggagagatgagggtaaggtaagcactaggtagggggcggctgagagttgtccagctgttgggcagccagcatctcctttgttcttgcccaacaatgttatccaggagtttgccagagatacatccagcaatatcctggaagcaactgaaggcagctcacaagaagacagttgtgcagtggaaggagggggtccaaacctaaggttggcaggttgactatagtacagttgcgattgtctgcattcttacagtttctgtcaaaacatcgttttcccaagtggctggtcagctcccctgtggttaacatgcttgcagcaatggatgagagctccagttgctccaccagcatttagtattgtcagtgttttggattttaaccattctcataaatatgtatagtgatatctcgttgtaatttgaattttcataataacaaatgacactgaacaccttttcacacagttgtttaccatctctctatcttctttggtaagagtgttcagatcttttgttcattttttaaattggcatttgcttattgttgagattgagttctttatgtattttagatacaaattgcctttacttttgatcagcctcaaatgaagagcatttttatcagctaaataaacctggctctgtaattgtggattccaacctcatattcctgtcttgccttgtgtttcagaaaatatctgaagaggtgcataggaatgtcacccctgggctatcaccagccatcagggctgtgttggtacgcaagcagtcacattgcctcccgatgcccagaacaaggatgttaaccgcacactggctcctgaagccagggaacattcccttcaagatggcagaggaaaggcgggggcagtggggtcagctggacatgcgtcaccctaccgtgctcagggaagatgcttctggcttcccctgggaggcagctagtgatgagggtctcacaatggaaaggaaatggaaatgtctgttctttgggttcagctctcatgagtccacaggtagcaccgttcatctggagaaggccttcacttgcacaatccatgatctggaagcttctgtggcaaggggccgatatacgtctccctacttatccattgaggagcaataagggttgtgactcgggtgtgcgtgaaggagagaagctccagagcccttgtctcaggtggcttctggccttctgttggcagaaaccattggtattctattatttctgtttttaaaagggaccttgagaacggaaattttcaagtgtgttttgtaacccttagcaaaaggagagcaaacacctttatgaaattctggcatgtggtccttttaacctttccaggcagtgtactggttcatgcaaactagtgctattcccttcttagggattggggtgctgggttctgtggaagcagtcccagtggtgagctggagcttgggtgaaaggtacgtgtgtgtacatacaccactttgttacatagtgttattgcattaattctgactgtccaaagtgattcatttgatgaaggcagaaatgcagaaaggacagtcacacacaaatcccatcttcctgaggtaacctctgtttccttcctgcaattagagctctggcatatgcatttcatgtgtgcatttgagggtggggctcagccacttggtagtctgttttcttccctgtccacgttcccaggggctgtttatcagcagctcacattggtggttcagaagaacattcgagagagacagctgggctggctccgtgtgcttactctccctcgtctaccccatccaacagattgtgaagcctggttccagtaaccttggggatgacaccaaggagcgctgagccctccaccccgcatgttgtggtcttgggggagggaggcaggtaggacacagaacagggttcctgccccagtggctcctcccagctcttgctagccctcccttggcatcaggcagacctaggtagcctcaggtcttggagtcccgtacagagctgttgcagagggggtcactccaaccttgaagcttctgggggcctggccgtgggatagtgcagagtgtggcactgcttttcttcccggctggtgtccctggggtcagctgccttaaggttagggccctgttctaggttaggacagggaagggcttaggaaacagggccagcaggatacagggaggaaggtgtgggcacggacatgcagcgggcaggcctgtgccgggaagagggtgggctttgtctcctgagaagaggtggccccccagagcactggtctccccacatggcaggcagtggggctctgtttcaggccctctccaacgcacttaggctgcgacaagcctgagcaggatgtagggggctactagacctgcgggcagggctgagggacagggcccggggctgccaggtcacctgttctctgcaagagggtttttgaacacaagggctttcccaaagggtaggggtaacttgctcctagtgggcaagaccgagagcccctggtggctccatgggcctgggctgctgcaggagaggtctgggggctttctagctcctccctgggggtctggaggttcctagcagaagccccggcactgttcacctgtttcagaaaaaacagaccgttgtctaatttgttgttgttgttgttttgtctcggctccctcaaaaaccaaaggcgttttttaggcccgtcgtccaaattacaagctcattttaattcggatgtatttactttgtgaaaccaaccctgaagaatacattgtttcgttatattctgctggaaaccttgccacatttttcctgagaaaactgagcctgctgtgcacctggagccggccaggtggcaggtgctgggcctggaagaggagcctgccgaggctcctccagggcttctgagtgccattgttttgagtgcgctgcctggtagcgctgggcccttccagggaactgcctggctccttcctcagctgcagcctcctgctgcaggggagctggggaccgtggaggtcccccacaggtcctcaggcccacatgcccccagcctgggcaagcctgccgtgaaataggcctcgtagagcctggctgtgggggcagcaggggcccctgggtgcagagggtagcctcgccgcactgtgggtgggtgcccctgcttgctcctcctggaacgtgaacgtgggcagcagtgttcctgttccatgctggggaggggctgtgagaatgtctttcttcccggtgtagcctagcctcaggcccacccttctgggtgtgttaccttggtgaggtcacttggtttctcacctctgacaagggtttcacatcaacactttcctgtcttccgggttggtagagtcagatgagcccagtgcaggccaaaagtaaaagctgcacccctgtaaagagtgtacatgcagctgtttgtgccattgagtgtctgtagcagagcttagcagggtggggtccctgcaggcaaggtcccccccaggagacacagaaggagagggcagggggaggaaatgaaggctgggggaggggagacacaggaagaggaagtgggccacgatggttgccaaaggctctgcagacaggggcccctccctcagttgcctagagagccggctgggagcacgggcacctggggtgcagagctggggctggctgtgcaggtgcttgttcgtgtcaagaagcagttggacttctctgtgagattctgcagatctcccctgtgactgtcaaggctggtgccccccaccccccaccccagacgtcacagccagaggcaggcccaagaggcctttccatactgtgtccctttccctacccaccacgtgctctgccctctttcttccctccctccctccttccttttctcttggtgcaagagaaaaccctttcccagtagtccacagattccctggttcctactcctcatgagcccctacagtggcacttgggatctgcatcctagtggctggatggacttggctctcctagctgccatccacctgggctaattttcagcccacagtggtgtcacaaagtggtcttatggcaggagtgtggtattcaggagcctgaagggggcttctgacgtggaattacaactctggaactgcttctgtttaaatcctttgctgaatatttgtcacccatagccttttaggtctgacccgttctaaactgctgggcctatcaaacaatttatcagggagggcccttctccaataggacagtttgcagcgtgacccaggggctctaaagccctggagccctgccctgggaacatctcctacaaagctagattggactttattgctatttttgagtttctcatcctggaagccactgcccagcacattctgaggagaatctgcctgggcgaccattgttattttaagagagctcttggggtaatatgaggaactgtgctttgaaatagggaatacagaatggggccagtaatgtgcccagagtgttgaatgtctgatttttaaattggcattattgatggctagcattttctagtttgctatggattttttgttttgaatttaactttttgaataggaaatgcatttgtgtgttttagaatctaaaagatttaagtagtttccccagggaaaattctgtcaaccttccctgttctccatctgctcagtgttcccctgggtgatctctgttcctactttcctagggaccctctctctgcacatacaggccaaggcgcacgtagatccttgctggtcatctctcctcaaccttgttttcctcactcagcttggagatctttccatatcagtttgtaaagaactcattctacttctttgcgatagtgttctgttatatgtgcgttccataatttatttgacaggccccagtggaaggacatgagttgttttcaggttcctgctgcattgactaatcaggagcatatcccgttttgtaggtgtgcaaatgcgtttgtaggctaggatgtcaaaagttcagatgtgggtaaaagggtgtgcacatttctaattttaataggtattgccaaatcgccctccatggaggttgtagcagtttgtactcccatcagcaaagaatgcctgcttacctgcagcctcaccaaggtgataagctaccaagctgcatttcagtgtgtctcatctgccattagctcctgatggatgaggtggagcatcttttcatgcatttgagagccatttgtagttccttttttatgaatgggctttgcccatttttctgttggatatttttctttttaaaattcctgtgagctctttctgtattggagattagccgtttgtgataggagctgcaaatattttttctctcagttttgtcagttatctcttgcctttgtttatggtgactttgttcatggagaagtatagtatactgttttgtgcagtcaaatagattgattgattgattgagactgagtctcactctgtcacccaggctggagttcagtggtgtgatctcagctcactgcaacctctgcctcccacgctcaagtgattctcctgtctcagcctcctgagtagctgggattacaggcgctcgccaccacgcccggctgattttgtatttttagtagagacggggtttcaccatgttggccaggttggtcttgaactcctgacctcaggtgatcctcctgcctcagcctcccaaagtgctgggattacaggcatgagccaccatgcccagcctttagtcttttcttttatggtttgtggactttgattcatagaaggaacttctgtcttacagttttctcctagaatgtttgtggttttatttttcacattagaatctttgacccatttagaatttatcctggtgtagggtgggaagtatgaacccagcctttccagatgctaccgaagtgtcctcataacatgtattgactgctccctgccctaggggttcgagatgtcactctgtcctttgcacagttaccactacctttcgttctaattctgccatttctgctgggcttcactggccagtgatcagcttacgaaactgtgttgaatcctggtggtctcgtttcccccacgtcattgttttgcaggatttttttctggctattactgtgtgtttttctgtatgaatttttaggatcaagttatcctattcgaaaacaaagcaaagcaacaagaaaaatgcctactttaaaaaatatcttcgcaagcattgtagaaatgtggagccacacatttgcccaaggaggattctctcactgaagcagtgttgcctccgacactgtggcagtctccagccaggcttcagcaccctgccagctcttgcatgtgaagagtggatagtagtgtgtgatcagcggcactagaccagagcgcctgggacagggcacacctgccccccatgtctctttcactactgggcggctcacaaacatgcttcccggggccccttggcccataggtgataacattgttatctcctccaagcaccactgtgcagcaggcatgtgccccacgtattctcccacttaaccctcacagtgactgagaaacaggctggatgacaatccctgaggcatcaacaaaggagtggaggtagagcaggctgcttccttgccccaggcaggttccagctgcggctctagctctggcgccagccagctgaatgacagctcactctctcctcctgggcctcacttcccttacctgctcagtgggtgggtaagagcttccaacctggacttcctgcgaagccatgtgcatgtcagctccatgtggcttaataaaccactaacatttctagagacgagcaggacagtcaaatggcctcctaaggagttaggaagtccaccccccaccacagaggccaggcctttctgctacccctgaggctgtatgcctgagtttcattggaggccagcagttgatcagcccctgtgtttggccatgctgacctgctccagaacaggagggtgaacagtcttcctggagtgaaaaacattgcagtcttgaggttgggagctagaagtggccccaaaccagtgcccacagggcagagctgtccatcagtgaatgacagcccactcactggtggggaatacctggagactggggacagtggcctgggagcctgagggcaagcaatttctctttggaagcctctccctgtgcctccctttgagtctgaccagcgctgcccctgccattgcctccagatacacacccacatggacccttgcgctccagaggtctgttgtatccaagacatccctgtgagggtgatggctcatttgcctttccaggacctcccggtaggagttgcatttcttcccttctcccttccatgaaggggagctcagcgaggcttcctagagaagacccagcaggaggccggcagaagaggcccttgcggcagacgctgctctggccccagcttggtaccgggcattggaaacattgcaaaaatgaccactcaacaggcttcccacaggaggttcgcagacagaaagatctgcagtgtggtttatacaggtgcagctggagccgggtggggtgggggggcccactcacctgtggggggttgggggggagtttggctaaggctggattgcaggagataacttggagcgtgccctttgcgcaggagggcagagcagagtggagtccatgccacagcccgagtctgagctcaggctttgagctggagcacgcacactcctgagctggctgcatttgcatgtggctgctgtgggggagaggggagggcctgggacttgggtgttgaggcggattgggggctcagctgaaggagagagagcccctgcgccccccttccggctggctctctgagagaacacgttgtccccgcctgggcctgcggcttgggcaagagcagcatgtgggacgctgtgttcctgataagatgaggcaattgctctcactcggggcgctgctccgctcgcggcctcgctgtggcgccagggaacatttatgtaacgcgcagccctgagcagctgccccgcccaaccatactccaatccccacccaccccactctccccgcaactgcatgcggtcccctaccctgcatcacccggccatgcagcctggtacccgaagagtcccccctctgcttggcacctgtaggacccccaaaccccagcatggcttagcccctctcccagctccccacagttcccccaaccctcctacagcctcccttcagggctccagggcacctagtgcccctccaggcttgaccccagcccccttcctctcaccaagtcttctcacaaggcctaaccccgccttgtcccacggcccccaccccatgcacaggcacaggcacacatagccagaacccctggggccctcccacctggggagctggagtgactctgagatccggcaggaaggctaggagctcctctgcaggagtctggaatctcctactggttctcttgtcattttggagctagagggagctcctgtcctggtgagtccctgtcttgctgttgctgtctgtgtaccccatgcccgggtggaggcagatgcagggtttgagcccagcaaggagggtgcttggatttgtttaggccattgggctccctttgccttagaatgggaggcgggctcactccctgaagggccgggcctggctggcccctcacctcactgtgtgcccccctgtgctcactgtactcggctgcacgcagccccgcctggagtctgtccccataacagcagtttttagagtgaagcttgaggacactcgcaggtgcctcagacccttcagaggggccatgagatcaaaactgttttcataacaatagcactgtttgcctcattctcccaaaagagtacagtaggctattgcagatgctacaggatgtgtgacagcaccacgacgactggaatgcgtgcttgggttgaagaccttttttccattttaatttgtaatttctaatacgatgaaagcagtggctcccgcccacatacaggaaagctcctggggctccctgcggatcatgtgggtgaaagtggcctggggcatgttgctccctgttcccgcctccacccgttctcccttctctgggctgctccttgtcagcctcctgggtgctgcctgagtgtcactaccaggggacccagccagacccagtgttgctccttgctagcctgagccataactcctgttgtgggccagttcattggccgtcacctctctgcagcaggctgagggaggagcagagaatggagccgtgggggccgcgtctgcctgggtcaggaccatgtctctgggccaggcacccagtatgtgccctgtcaaagcataaagctcctgatatatagggaggccaagagctgtgctggtggagtggctgcacccaacacccaccttcctccactccaggctgcctggcaccaacgtcccatccattggatgctgcatttctctgcggccccaacaccatgtggtccacctgtagctctgtgtacctcacatgcttccccagcctgcaggcagaagaagctaaaggacaaggctcctcacaagggctattaggaagcaaggctgagtctgaatttgggttggcttccccccacaccaacaggcccaaatcagaggagacccagttgacagggctaatgactaagagcaacaataacagctgagatttcaggagtggacctttggaacgtgccaggcgctgtgctgaggccggtcgtgcgcagccccatgggatcactgtatggaccccccgcatgaggacggggcagtgtgctcacttcctgtggctgctgtcacacattaccgcaaactgggtggctgaaaagcaaccgaaacttactctctcacagttccagaaatcaaggtgttggcagggttaattccttccagaggctctgagggagaatccactccatacctccccttccttcccctgccccctttctcccccttctcacttgctgccttccccgtctccctcactcccctcccctcttctccatgctccacacttgggagctcatctccagatcctgacctgattacatctgcaaagaccctttttccagataagatcacatgcacaggttctggagggttatcacttggctatatcttttgggggaccattatctgccctactgctggcagcacggagctttttcgaggccatagcgtcacaactcagggcaaacagggtctgaacctcatctgtcagacctgacatggttaatgctaaaccatttaatgctggactttcccaagcttttaatgactagtgtgcgttgtgaatctccaagagtggaattatcatgcaacattttcactctttagttgacaaaattttttttctggaaacgataaacagttttatacaatgataacatttctttgaacatgttttgggaaatattggactagatatttaaggaactatatttaaacacttcttcttcttgttatggaagaaacaaatacataggatttttttaaaaggcccaagccaggcgtgtggctcatacctgtaatcccagcactttgggaggctgaggaagacagatcacttgaggtcaggagttcaagaccagcctagccaacatggtgaaactctgtctctactaaaaatataaaaactagccgagcgtgggtaggcgcctgtaatcccagctagtcgagaggctgaggcagaagaatcacttgaacctgggaggtggaggctgcagtgacagagcaagactctatctcagattagatagatagatagatagatagataggtagatagatagatacccataacacagaggagcttgcaacaaaaaaaatcctctcaccagtccagccccactccctagacagcaacacttcttttctgattttagttgtcttgatggttactgccataaatgaactgtattttactgctgtttcttgatttatcaaatttagatattttctgttatcctcctgccatgaaatttaaggatttacctgactcctatccctcccctccaactcttcctaaattgatggatgtattattttacttattttgttgactatctttgtaattttaaatctctgtgtttcatttagatacgttctttgcacactgtgtgcattccaacttttcccttaaatccatgttctctgctgggcccacaggtcagttgtatggcctttgtttataggattggttctgaaacattgacaactagtgctaaggttagcatgaccacaactgtgtaaagtttgcttccatcagcagggcctgtgctgggattacatttcctgccaccacctcatggagttgttgtgaagaataaataatagagcataggaaaaacccctagaaccgagcttggctcggagctcttgacccataatcatgaggcattttcgtttacatctaatttgaaccacaatttttttgtatgtcttttatttttcctggagtttctaattgcctcttttttcttttaaacaaagaagagtggtgtgtctttactgggtcctgaagtttacccagccttttgatggtactctctggtgcacaaaactcactttcctcctggaattttcccccgtgagtcttggtcctgtgctccagtgacctcccggggtctctgcctcactcttgtcatgcaatggccctttactattcagtcatgtctctagctccttggttttatctcattttagctggagtgtgtgagacattaacttggaaggccctgttcctttgtcttcaggatccagtgtgacttaggaaaagtctgatgtctatcccagccttgttcctttgtggatgacctggtgtttgtttcttccccctctctctattaagctgtgagagctcctgtttttactcagtgttctgacattgcagagcttctcgcagcagaggtcttaactcatttacctggtccacctctgtgcagcctgtctcatgttagtttcctgtctcctttttcttttttttttttttttttttttactctttgacagagactgttctattatttcttttgtaatttcttctccatgttttctgttttctcacttgattgtaattgtcgtgtatttgggaaatcgtggtggctacttgattttgaatccccccaacaccctttcccccaacatgtaaaatcaataaagagagcaagtgtacccacacacggcccctgcttcagcagtaccaggagacggaacatcgtgacatccacatattttccagaactgttttttggttctttttttctcatatatttgctttgagtatatttccagcttttatatgaaagttttatatgcacacaatgctgttttcaattcctaaatgctgttgtttttgctttttttttttgagacagacccttgctctcttgcccaggctggagtgcagtgacacaatcttgactcactgcaacctccacctcccaggttcaagtgattctcctgcttcagcctgccgagtagctgggattgcaggtgcacaccaccacacctggctaatttttgtatttttagtagagacggggtttcaccatgttggccaggctggtctcaaacccctgatctcaagtgatccacccgcctcagcctcccaaagtgctgagattataggcatgagccaccgcgcctggccgtttttgctctctgaacttctttgtatggtatcctctttgcttttgcatcaaatttcatctcaaattcctcagagaatactaatcagaaatttcaagttaaaattttcttctctttcctggcttcactcttttcctctagagttggtggttgcattgcgcttggcctttcttttccatgctgctggttctccctggctgtctggccatccctgggtatctgcttgtgtttaaggtgggtgggtgagtgggtttcctctgttgaacatgggtagaccagcttcagtgactggcagtcactttagggtctgtatgggggtgagaggggatgagaccgtgtaggaagggcagccctgcggccacccctaatacaagaagggctcgtttctggggtgccagagccccccaccctggttcttcctgagcagttgatgtcatttttgtgattcagagttttgtgtgttgagtttgcctgggtaaatgctggcctgtctcccgctccgagtgagggatgggaaggagggagcagcatcctgaccgtagccaaccttcattacctcccaccccactgtgttctgcctcctccctaccggcacaggcccctataatggggtgctctgggttgctgcccttgtctgtcaccacacttgggtctgcaagaggctgtttcattctcctgctctgccagccgtccctggttggtcactttgggacttttgtgagagaaggagcagcagactggttgtagaattccaggccccggaactcacctacgctgaccctctcatgtgacagactagactgaggagggtcagaatgggaattgccttcctgccctgcaggggtgcagagtgtggctcccatggagcagcatgggcggctggactccgggaggcctgtgaagccagggcatgggcctgcaacccccaggcgttggagaccactggcccggcatgggtgtgtagtgcagcctgctttgtggtgtacttagggggtccactgccaggagcctggggccctgacctgtacctacccatgggccctgcagcttcagcacctgaaatgctgttttatcctaggccgtgtcctctgcctccatcccaggcgtgggcgggagggcaggggcccaccttcatctctgccttgatggatttgtcacagaagctcttggaggtggggcatgtgggaggggtgttgagagaccagggtgttgggtgttgcgggcccttccccagagagggtgtgaaggcggggccaggtgcggatactgatgctctgcccctgtgcccacaggtgagaggcccttcgcctgcagctggcaggactgcaacaagaagttcgcgcgctccgacgagctggcgcggcactaccgcacacacacgggcgagaagaagttcagctgccccatctgcgagaagcgcttcatgcgcagcgaccacctgaccaagcacgcgcgccgccacgccaacttccacccgggaatgctgcagcggcgcggcgggggctcgcggaccggctccctcagcgactacagccgctccgacgccagcagccccaccatcagcccggccagctcgccctgagcccgccacagccatgagcagccgctcccaccccctcgtgagtccctggcctttccttttgtaataagaaagaagagagagaacttgatgcaaagtccacgaaaaaacaatttttttcacctcaggtgtcaaagtaaatttgttaaaaaaacaaaaaaaacacaaaaatttcaaaaaacaccacccaccaaattgcacaatagatacacccacaaagttgagattcagcgttgttgaaccccctttctcagggatggacacgtttcacgaggtcagtgaggacaccccttcctgccgccttactctgtacatagatttgcactctggagttttctgttaggttcgggaacacgctggggacagagcaggccagccagtctggtggagctcagcgtctggctggctggccagcctgtgggtctgttgggagcagatgtgctcactgacgtttgtgcctccagggcagattcctaagcagctggcctgacctcttcctgcccagcccccaacccagtctctggcctctgcccaacgagcctggctgggcttgcaacgcagctgattctgagacaggcccctgcagagggatgccttaaagctgtccctggctggaggagcactccaccttggggatagtggagggggccttcagccctctgcaccctgcctgcctcacaccccgccttcaggagccctctcctacggcgctagggagcactggaagcagagatgccagccctggctgagcgtagcactgcaccgtccgacctccgaggcaggggccggggtcacacctgccaggactccgcttctccgtgtcccagcagaaggcatgcaggaccctgtcactactatacctgggcctctgatggggaattctggtcttctaaaaagatgttagaaattcctggtggcacatccagttccgagtttgcccgcacgggcacttttgttggaaacagtgggcaggtcatggggcctcctcatcagagggtctgtgtgagcggctgtgcatgtggcagcgcaccatgcttcacagagaccattctgtagcaagagaccggaacattgtgacttggaccttttcaggagtggcgcggatgttacaggaaatgctgtcggagagcgcgcattctatttcctccgcagggaatgccagatagaaagttgcgggcaacacttttctcagacccaccatgtccccaactcagacttagcaaacctccagcctctccgtttcccctggactcctcctcccttttcctcctgcttctccttgtcctgcctggaggctccaggccacacccagctggtggggctgctccagtgccccatcaccggccttctcctggcaggagaggaggagcagagagctgggtcctgggctgggattcgagccctgggcgggggtcagtcaagccgtggtccagcaaactcctctgcagatggctggagtgttgacccaggcttgtggcccaggtatcaccttcccttcctcctgagagttgaggcctgtaaatacaagggcccaggacagagtgtgtgcgtgcgtgtgggtgtgtgcgcgcgtgagcacacacgcgtgtgttggggggggtggggggattggggtggactcagggtatcttgccagagatacctgttttgatgagtacctattttgatgcaaaggaacggccctgggacctcagagggccacagatgggcttcctgggcctagcgtgccttggttgtggccatcctgcttctactcagccctgccatgctatggggtgcagcacaaacccaggacccaggcctagccactgcccacagctgatggtcactgttttggctggctccagagtggacaggtacgctctgtccacagcagctgctcaggcacagtatgccgtcaggtgcccgcttcttaccactgtgtgtcagctgggattggccgacagcgtggtggtgacttctaggtagaccgatggaccctaaattgggcagtggcattgtttctgctgtggtgggaactggcagggagagggtcacctccactctggttggatgcggagctggtccctctggctgccatgctgtgttggggctctctgacctccctgcttgcattgggtctgggagagagagtggaatatttggtagggaccttgacagaagagagccctgggtgcttgtggtgcaaagatcttcatgcccagttccaaagtgaggtccctcccaaagttgttttcgtgtgaggcagagaaagccacactctgaatacattttatgtctcaggaattcacattccaggttcaggaattttattccaaagtcctttggtgcactcaccgtccaccgttccccaaggcagggagagggagtggcccgtccctgggaggctggcaaagtgctctccagggaggggtcagacgtccttgtgatctgcccagggtgtcacggaaggagattttctagctccacatctgtctgcacataggaaggaaaagataggactctaaacctagtcatcttggaataaaaagaagagctggtttgttttagagcagggcggggggtgggggagggaagcgggtgttggctgtttccaaagagagcacttaatttaatttttcctttaaatgacccagggctgttccgtctgatagatggaagggtaacattgccttaaaacagaaatatgcaggcgttggctatttttggcataagagcgtgtcttcattcccaaagtggttctcgtttaatggcagggtgcggtccttaggccccggcctggactgggaaatgggggtagggcaccaggagagaaatcctcctgggtactcctggccagaccctcctgaatcatctgcggcttaaactcatctcgcttgaagggcagggagaaacccatgaatctcaggcacggttcacaggggtcctcaagggcaggtttccatttcatcatgaagtgagggactcctgtggaagagggtggtgggccttggaacgctgcctccactgaggcgggcacacaaggcggaccctcctgaaacagcctccattttcttcaaacatgcagaatgttttcccagactgcgtctatttcagggtcttccatttttgtggtttatggccatgcttgccagttttggtggggttgaggaacccataggactcatagaaataatagtgaaaactcaaacccttattttgggacttcagttctcgtggtccataggggcagagatgtcaaagtgaaggttgcctgagtgaagggagagttcccctataaaaggcctaaaattgatctggggctcagccatcaaggggctggtgttgctcctgtcccagacaaggaagcccctctttacatcagccatattaggggaacggttgtcagctccccaaatgcctactggatcctacagccatacaggaaaacagacggacacagccctttccttaaagagccctggggtcctgtcctgcaggatgctgcataggaatgggcagagatgtcctggatgggaacatggtcctggaggtgccctacctgcatcctgctgcacccccacccacgacactcgagtgcaagatcgcctcactcctaaccctgactttattcccaggccccacaccgaggcaggtgcaggattcgccatggtgcagcctccgggtacaaacatctgaggcactggcgatcccagtccttgcagcaccctgaacacagctcagaccagtgaggggtgattcagaggtggggatgggcagagagggctggccactctgcctcaggacttgacctcaagtgttctgtctccccacccggtgtgtccagaagaccagcctctttcttgccagaagcaggtgctaagatggactgcacagggtcccggcactccctcgggacccattcaggatctcagctgggcaggggtgccacccaacaggaagatgtgatctgagcaatagtgtggccttgtttctccgcttctggttgtggctgtgtgtacagggctacctattttgacttctgacaggtgtcactgattttctttcccccatttaaaaaaggtcatttagtcaaagacacagtgctagaggtttaaagggtgtaatgtgttggtcacatcacaaccagtaagaaacgcttggtaggttatccacatcttttgctgactgtttccatatacaattctggtcaccatattttccaaagctaaaatctgaggcgtgggctgatggtttttgaaatcaggattaccccaggaagaaccaggtcctattactaattttcctgattctgaggctctgaaggcttgtctgagacacattccggagacctttgtaccagaacttggatgcatagtccaccttactactgatacacgcctgagcaccctttagggcgaggcgccgcctcctgcctgctgtcctgtccctcagcatcagaagagttgaattcagcaggagacgggagcccggtgtccatgagggaagaggggtcgcgcttggtttctactgacccccatgaagatttcagacttgcagtgcggccacctggccctgccctgcctctctctttctcatacagctttaaaactttactacttttatttaaaaatgaactggatgggagagaagtagcgtcccctaccctacaagtcacacattccggggaggggggtggggggtggaggcaggaagtcatgggggtgggggtgggagcacgggaacagctttcttaaggcctcagggtcctgttttccctggcctcttctagagggcccgtggacaggtcgcagtgcgtgcttatttggaaaccaggtgtgtgagccgaatgcctgccaggccatgcactcagcagaggagcccttgtacctggctgccctgagaggagcaagaggccacctcccatgtggctctagacaccacgtgggctcattagccccagcgtctgtgccggctccaggtgcctgcctctgggtgtgtgagtgggagactttgctccctggcctcatcctagagaggcccctggtgcctagtgctgaggcctctggggctggaaagcctcagcagaaaggaggcactactgagcaactatgcattgtcattgtcgggtttggggctttcggtggttccttggtgactgggaattgcttgtgtgcatgtgttgggtgcatgcttccgggtctcagctgccccaggcccgcacaggcaaccccttcccatccaaagccattggtggagcttctctggaatcatttgccaaaagcccaaggcagaatccaagggtccaagaccatttccatggagctcatgtttttcttttctgtaggaacttttttttaaccagcacccaccataattccgaaggccacgtttcatctttcctggatcactacagtgaagtattacagttgtacagttcccagtctggccttggcttgctcggataaaactttgtatgtattttgtatggcatagattctatattgtaatgatgtcctatgcaaaaagaaaaattaacgaaattgtaaattttattgttttaacgtgtatgcatgtttagtgacgtttacattttgaaataaaatttatgattcattatttta

SEQ ID NO: 51 - DNA, 172214 bp, Homo sapiens
gttctctcgctcaggtctctgcatgtagttgtcacttgcagctccatttccatcacgtggtaaaatgccctttctcttctttcctgcagatggatggtttctagtgtgcttccaaaccccacctcggctgagtgttgggcagcacttctacatgatcctatgactcttgatatggacgcagtcctgtcagactttgttcggtccacgggggcagaacctggtctggccagagacctgctggaaggtaagcccacctccttgttccccacaccaccattctgggcataaccaccttccaaataagaagatttccaatacctgatgacagtggtacttgagcactaagtgggctttgctttgtgttacatcttaccgatattaagtcaaaattttatcactaattattatatttaagaaaatatgttcaatggagcagaaattataaaacattcaagaaaatacttttgtggtaggccttagtttcatatctctgtgttagcggagacgaaaatactctaggccagggtttttggtggaaaaagcacctactatccaggaaagccactgggagtaattcacaagcaagaagacagccttcatcctccagcttttcacgtagataccatttgctgcatgagaaattgcatcctccgtatgtatgatgttttcagatatgtattcagccataaccatagtgaactaaaatgaaagtgtagtttctatgtctctaaaatggatttacctttcttttttttttctgatggcggcagtggtatgtaaaggtgggagggaccagttacaacttctcaggacagtcagctgtgtgagaggagagaactttgtaatgtttactctttacttcaaatgtataaactgcaatttgtggagttagtaaatacttggtcaagaattgtaagtcacaatgattctttaagtcacttagggaaaataagaattattgtacatttgcagaagtggagagaactattcaatcatattgaaaattaagaaccacctactggaggattatcaaaaaatggcaatggcaaaagcatagtttttaaattttccccaacctattagaatttcaaaccaactccaagtttagaataaaatatgctgagagtttttgcaatctatggaaatcaaaatatgattctcccttcctgctatttatattatataatgtctccctgtcagtttccattattttcattaagtgggcagcagagtggagaagcaggcttggaataaggtcggcagtgaaatccgagtttgagttcagattcagccacttatcaactatgagatataggacaaattattttacttcccttaccctgagatttcttctatgttgagcttaacccaccttacaaggtgactgtgaatattagaagttgtgatataaaatgtgtggtaaagaagcagcatgtagcagatgctcaaaaaagtatagaagaccatgcttgtggtggccattattgtaattagtactaacatcagtattaatgtctagacagccttataggaagcaagagttgtcatctcttttctttattttttttacttatatttttcacattaagatacagaaaaattgagttttttgtgtctagttctatgaactttaacacatgtatggatttgtgttattactaccacattcaggacacagaagcacttcatcccctccagattctctgtcctgatgtcttttataatcagaccctcccctaccccaaccactggcagtcagtgctctgttttctatcactagttttgtctctttgcaagaatgtcagataaatgtcctacagagcctaatcttctgaaactggctccttttcatgcagggagatcattttgagactcatcaagtcatgtgtcagtagccggttcctttttgttgctgagtagtattccattctgcaggtactccagaatttctccactcatctgtccaggggcatttcagttgttttccatttttggcagttacaactagagcttctagaaacatttaagaacaggattttgtgaatatagttttaatttttctttgttttttcttttttttttttggtgacacagagtctcactctagcccaggctggagtgcagtggcgctatctcggctcattgcaacctccgcctcctgggtcccagttcaagcaattttcctgcctcagcctcctgagtagctgtgattacagccgcgcatcaccatgcccagctaatttttgtatttttagtagagacgggatttcaacatattggccaggctggtcttgagctcctgacctcgtgatctgcccgcctcagcctcccaaagggctgggattataggtgtgagccactgtgcctggcctagttttaatttttctaggctaaatacatgttaaccttgtaagaaactgccaacctgttttccagagttctgtaccactttgcattcctaccagcagtgcctgagagctccagctgccccacatccttgtcaacacttggtatttcttccttttttgttttttcattttaaccatttgatagctgtgtgatggtatttcttcatggttttaattttcattttcctaataattaatgacgttgaaaattttcatgctgtttattttccatctttttattctctttcgtgaaatgtctgttcaggctttttgcctatgtctaaattgagttgtttgattgagttttaagagttctttacatattctgaatataaatcttttgttcagatttgtgatttgtgaatatcttctcccaatctgtgcttgacttttcagtctcttaacagggccttttacagggcacagttttaaattctgatgcgttccaactgacttttttctgaggatcatgctttgagtgacatatctgagaaattttgcataactccaggtcatgaagattttcttgtagttggtcttttaaaagttttatactttcatgttttacatttagatctatgatccatttgagatgatttttgtataatatgtgagatttaggtccagattcagttttatgcatacggatatccaattgtttcaacatcatttatagaaaatatcctccttctttcattgaaattgaattgcctttgcaatttgacgaaaagccaactgagggtatttgtaaggaatatatttctggacagtggttctgttccattgatcattatgtctgttcttttatcaacattgtgccatattgatttctgtagctttgtaatgagtcttaaaatcagatagtgtgatttttctaaatttattcttctttttcaggagtgtttcagctattctttttttttttttttttgcctttctatgtgaactttaggatctgcttacctctatctactctaaactgttttgctgagattttgtctacaattttagtaaatctacaactcaatcctatgttatgtctttcagtccatgaaggagtgccataatttccatttgcttgggcctccattaagttctttcgtcaacattttatggtttttggcatgtagatcctatacatgttttgttctatgtgtattggggggcggggttgtaaactattgtacatggtattttttatttcagtttctacttgttcattggcaatatacagaaatataactgatttttgtgtgttgatcttgcatcctgcaatcttgctaaagctaaactcagtttgttctaggagggctgtgtgtgtgtgtgtgtgtgtgtgtgtgtgtgtgtgtgtgtgtgtgttccttgggattttctacataggtgatcatgttatctgtgagtaaggacagttttatttcttcctttccagtctctaggcctttctggttttcttgtcttatttcactgacgaagactattcaaaaggttaaatagtggtgttaaaaaagaagatccttgtgttgttcttaatctctgagaacaagcagtatttcaccattaagtagaatgttggctataggttttagtagatggtctttatcaggtgaagaaaatttctttctattccaagtttgctgagcgttttataataaatagatactgaatttttaaaatgaagatcaagtgggttttttgctttaaactgttgctatactagattaaactgattgccttctagtggtaaaccagactttcagctatttctttccatgtttctatgttctgccctttttttctttccttctgggactcagatgataggaagctcggcccttttgttattacctaaggtctctatggttctgttcaaggttttcaagctttgtctgttattcagattcagtcatttctattaatttatttatgaactgactgactacttcctccatcatcttcatcccagtagtgagcccagccagtgtgttttctatttttgtagttgatttttttcatttctaatatttccacttagttcttcttcatatcttccatttctttgcaaaattttctatatgttttaagagtaccctcctttacttgtacaatatttttaacaactgcttgaaaatctttgtcaaataattccagtatctgtttcatctcagagtagctgttggctttttgtatgctgagtatggtttcagtatgctgaattgtatcctagacattttaaatactatgttttgagattctggttattgttaaaatcttacagtgaacattattaactttattttagaagataatcaccccaaatgggttcagaccacaaattccaagttcctgcaagacttgtgtggattgtggttgctgtgagtctgtgagatgtggatctgtctggcacaagcgccacctagtggccagcctgggactctggtggtaatctatcccacatttcagcactcaaagtctgtgtggtccgtgtagggtcggatccatacatgtagagctcaagggtaagcccaagagttcatgagcaactttcaggggttgctctcccgaagcccttcctcattgtaacctgcccagtagtgtctgggtccctgggctctaccttttcagccctccagccagcttgggtggttgaggcttgatttaccctactctctggtgcacttgactgaaccacgtcagagctaagcagcgagaagccagagagaaaaagcatgaaggtttccccaccctctggggacctcagactctctggttggaaaggaagtttgcctggcctgatgactttaattatctgccatttctcactagggccacaaaatttcttgaggtctggggcacagagaagaaaaaattttagaagaaaaagaaaaaaaaaaaggataaattagagatttccagactttcttagaacggtagagacccctttcctgcttctgtacccgagttggctgggcttttcctggaattagtgcccactctgggttaggagctgcattgactccacactggggagactggaggaagggaagtgtctcgctcacctccaactctgtggcacttccaactgtggtctcctttctgcatcagcacctccaactgtgatccaccttcctgagcccggtcgctgctgcctgcacgctgtccaggggtcccggctgcacccagtgggacagagggtggcagtggtgagtgctcactcacctcacccactgctgggtcctgcctttggctttcacaggtaagaggactgtggttccattgtgtatgatggattatttaaggtgtcaaagttatttgggtgaagatttctctaaacccagtgtttcaaagaatgaaatatttttgttgtaagtcctcagaaagatgtgtattgggaggatgtcagtaatgtaggaatttagaggggagatgtctaaagggaaataaatcctcatggtggcaaaagctgagcggaaggtacatggtcctcatttgtaacttcttgtatttttatttatttcaaaaaaaaagttaaaaaaacactgcaatgatgggaatcacagtacagcagagggaggccaataagagaaaggaggagcagaggctgatcacaaccttggtaaactgaggcaagtgaacactgacctgcctccaaacagaagagggtggccttgcctgttcacctgcttcctgtgttaccagatcaaagttgggtctggctctctggcacagcaaagccaaaaactggcgtcaagactgcagtaagagaaagtgagacatttatttcagggcaggaagccaggagaattgggcagctcatgtttaagccctgaatcccccagtgccatataggtaagcgtttttacaggcaggaagaggctgggcgtggtggctcatgcctgtaatcctagcactttgggaggcctaggctggtggatcacctgaggtcaggagttcgagaccagcctggctaacatggtgaaaccctgtctctcctacaaatacaaaaattagctgggtgtggtggcatacacctgtaatcccagctactcagaaggctgaggcaggagaatcgcttaaacccaggaggcggaggttgtagtgagctgagatcgcaccattacactccagcctggagacagagcgagactccatcttgaaaacataataataataaaataaaggcagggggcagaagttacaggcaaagatataaatcaatacacggaggctgtacattggtttgacctaaaaagacaggacatcttgaaccagatgtggggtggagggcataggtcataggtagatttgaagattttctgatttacaatgggttaaggagacgaagctttgtctgcaaatttgtgatcaggagaaaagaacgttagctctggtctctgggcatgacttcctccaggcccctcaggaagaaatttagaacaaagagtggtggtccaagctcagtcctcagtttcccctgtctgaggtctgcatgccagcagatagcacttttcatttgttggtgtcctggtttctggaaatcagctcaaggacttgtgttaaaatgttatctttagtctctgtgggaactttgatctattctgtgacttaaacttccctggctattgttttaagttattcttcccttcttgcttcagttgctcatttacttcccagtgctggctaggtacctggaaatgcctttgaaggaactcaagatttccttttatttccatgcttgggggcaggtgcccggcaggcccctaagaggggtctctgctccatctcatcttcatatcagtcccttgcatgtccctgaagtggttctcccaaacaaattcaagtcaggtaactccatttcctccaatttttcatactccgtccccattacctgcaaaataaacttctccacctggtactccagcccttcagcatctagtcctattccgtccctcccctcattacctgaggcatctcttcaccatccctttccctgacttgacacccacctctgtgcttctgcctccgcccattgctcctgctgctcctccccctgcacacactgcctccctgttgaaattcagctctccctccacgatggatcatgaactccccgacagcaaggaccatacaaggttttgttcactgtttgcccaacacccagcacgtatgagtccctcagtagagtgatctattaatagctgctgaggtgcagtgatgagcagccagacagaaattgcccacatggagacagatggaaataagttatatagtgtgttagccattagtgctgtggagataactaagtcggggagaaggaagcaggtatgagtgtgtacagttttaaattagggttgtcaaggaaggcttcacttaaaaaaaataggatctgagcaaagatttgaggaagtgagaaagcaagccacgtggatgtctggaggaagaagtttctatgacgaggtaaggattcactgataattccttgccctcctgtggaactttgtggacttctgctgcagcttgtgtttggttgtgccttattttataattcatcacatgcttatcaagctggatttgcccagtcttgagcacatgccactgatttagcagaattcacggctctggcgttttcaagtgtgtgcgattagaggactgccatgggcaaatcccacacccttgaatgggaacaaaaaggtggtctagggaccatgaatcctaagcaggagttaacactcgaccacaaggtgtgatggcccttggccggggctgggaccatcagtgggtctagaaatactgaaaggaaaccgttggctgcccttccaagtgtcccgttcccactagagagagctctgccgttagaccagacgtatttggggaaaaaatgtcaaaaaaaataaaaataaacatctccagatcagaattctaagatactccctctcgcctggcctcattcaggaagacacattcttcctttagagagatgagtgtatttaaatactcttaaacagacccattaagaccatttgcagtgagtttccttgtgtcacgctgatcaattaagtagatcttatttccttcctattggggaagcttgtaacccccaggtaccatcactggcctattttgttggttttactcagaagtctgtgccattgtggctgcttaaaattaaacactttggccaggcttggtggctcacgcctgtaatcccagcacttcgggaggccaaggcgggcagatcacgaggtcaggagttcgaggccagcctgaccaacatggtgaaaccctgtctctactaaaaatacaaaaattagccaggcgtggtggtgcatacctgtaatcccagctactcaagaggctgaggcaggagaattgcttgaacccaggaggcagaggttgcagtgagccaagatcacaccattgtactccagcctgggcaacagagtgagactctgtctcaaaaaaaaaaaacaaaaaagaaagaaaaagaaagaaggaaagaaagggaaaggaaaggaagagagagagagaaagagagaaagaaagacacttcctctctggaaagccagccgtattcatcccagcgtctttcttggtgtctgtgcatggataaagcctccccattcccccgtgccccccaccactttgtgtcctttcactttgcttcacttatgtgcccaccactccagggctccctgaggtccaggaattccatgccattccctttcacatggctgagagccccagccctgtggatgagctgtcctgagtgggcactcagtaatgtgggcgtaagctgaagagggaaggagcaaaaaaacaaccagaagccctcagattcagagtcatgtcgttaaacactttttaagataaaaaattggctgtgcgaactgaaatcaatttaaactattttctttgattaggcaggaaagaggaggctgctgcatattaagaactcccacttaagccaaaccttcatgtttccaatctccaagcaggcgttgagggcctctgggctgagtgtgggagacccaggaagaaagaagagtaggccctgccttcaaggtccttcctgcctaaagcaatctataggcagctgtgttctaacaaaacttttatttataaaacaggcagccagccagcctatgggcagtagtttgccaacctgtgctgtagattaaaaaaggcttaagagatctgtcaaacagtgataatgtatgcacattatttgaatactgattccaacaaactaaaaaagaaaaattataagacaatctgggaaatgtgagcacttaacatttactggatatttgatattaaagaataactacttttagatatgatatttttattatgatagtgctaagaaaaataagatacatactgacgtggatggatgaagtaatatcatgcaggggttttctggggacaggcgaatgggtgggagaggagatgaaacaatattatccatgagttgattttgattaaacctggatagtagatgcaaacaggtttattataagtgatgtacgaatgtttccataataaaaagttttaaaacagacagcaccaggaaacttccacttccagccaagatgaagtatcagaatgtgggtgtgccctcctgcctgaaaaagaaaaagacaaatatgataaacaagacactgaacattagacagtaaaggacagtagtccccaagagattggaaacaaacaaggttagtcctgtaattgcccagctcactgccttgagaaagtttctaatccgtggtacagggagggggaacccagaggaagcttgcctgactccacagtggaaggagacagagcttagagtcccaggagtccaggaggctggagtccacaggtcagagcctgagagcggagacagctacacagagagaactgcagcgattcacagagggtttgcctctgccactcagccaagtgccgatcagtgcctgtgtgtgaggaagctgtgtgcagctggggagagaaccacctgagaggattagaggaaacagtgcctggggctgatacagagccatggaaagtgcctgtgctcaccagccaggctggacaagcactgaatataatacctagaaggatcttgcctcagtaattgggaataattagccctgtaatgaaaacttttctagggctagacacagtagctcatacctgtaatcccaacactttgggaggccaagccaggaggatcgcttgaggacaagagttcaagaccagcctgaacaacatagcaagacctctgtctctacaaaaatcttctaaaaattagctgggcatggtggcatatacctgtggtcctggctactcaggaggctgagttgaggagatcacttgagcccaagagttcgaggttatggtgagctatgatcacactgctgactccagcctaggcaacactaagaccctgactctaaaaaaataaaagtaaataaatcactctgatcatacctaatgaaccttaaaagcaagaagcaagatccacaaggatcacagtgaaatggcctcattgcctgatccaaagttcttgatctcacagccaaggaagtcaaggacacggccacaccaagggtgaggttagagcagaagcagaagtttattaggcaaaagaaagataacagctctctgcagcagagagggatccccaaaagcgttgccattcagcagtgaaatgcaagggtttttataagctagctagtggggaggtgaggtgttatcttacctacatagggtgtgaaaaaccccaggtgtgccatctgcgtagagcatgaatctctggcatcccccaccccacccttttattatacaggcaggtcttttgcctgagctactccacgttgctttcctactgtgtatgtgcttcaaagggggaggtggagcctccatggtggacacacctggccccaggtacccctttctgtctgtgcagctgcaagcatccccccgtgcaagctccagcttccttatctgtttgcagcccggtcttccaggctgctttctattagaagaggagtgatttcctgggctgctttttgttagaagggaagttctgccaaggactctctgccctaactatctgcctagctggtctctttttacctcctctctcaaaagtatttccaagaaatgtaacttcattctacaacaaagctcaataatatttatagaaatataaacttgtccagcaccaaataatgtaaaagtcttgctgtctggcactcaatcagaagttatcaggaatgcaaagtagcaggaacataggacccataatgaggagaaactgttcaatcaaagtcaaaccagaactgctagagatgttaaaattatcagacaagggcactaaaagttattataactgtactctatagaatagaataaggtacatactgacatgctgttcagatgtttaagtaaagttatggaagatactttttaaagcctgagttgaacttccagagatgaagactacatctgagatgaaaaagtaactcagtggaattaacagcacattgcttaatacaaaaaaaagagaaaggttagtgaacatgaagacatagcaatggaaaatatccaaaatgaaacacagaaaaaaatagaagtaaagaaatattaaaggcatcagtgaaagccaggtgcagtggtgcatgcccgcaatcccagctacttgggaggttgaagcagaattattgcttgagcccaggagtttgaggctagcctgggctacataatgagaccctcatctctaaaaaagaaaaaataattaaaaattaaagcatctgtgagctgtggaaaaatgtaagcagcctaaaataagtgtaattggaatccttgaaggagaggcatgaacaataggaaaaaatgattcaaggaaacagtacctataagaaaatgtataagttaaacacctctattagaaaagaagcagggcctcaaatcagttaccttaatttttatcttgaaaactagaaaaaaaaagagcaaattaaacccagacagaagaaatgaaataataaagaccagaacaaaaaacagtgaaatagtaaatggaaaaatagtagagaaagtcagtgaaaccaaaagtgggttctttgagatcaataaaattgataaacccatagccacataatcagaggaaaaagaagatacaaattaacaatatcaagaatgaaagagatgacctcagtacagattctcaagatattaaaaggattataaaggaatattataaacaattctatgccaataaatgcagcaagttaaatgaaattcacaaattatttgaaaggtacaaaataccaaagcctatgcaagaaaaaaaaaaaatgatttgaataggtctatatttattaaagaaatctaagttgtagttgaaaactttctcacaaagataactgcaagcatctatagcttcattggtaaattctaccacacatataaagaaaaaattataccagctcttccaggaaattgaaaaggggttatacttcccaactcattcattctttgcgccagcattaccctaatacaaaaccaagaaagactacagacaaatattcctcatgaagaaaagtgtgaaaacactgaaaaagattttagcaaatcgaatttggcagcatataaaaaggatactacctcatgaccaagtgggttttatcccaagaatgcaaaactagtttaacattcaaaaatcagtcaacataattttccatattaacatactgagaaacagaaggtatacaatcatctcagtaaatgcagaaagagcttttggtaaaatccacattcgtccttgatttttagaaaacactcagaaaactaggaatagaagaaaacttcctcaatcttatataaagtatttacaaaaaagcctacagctaacctgacacctagtgatgaaagaaagcttttccccaaagatcaagagggagataagaatgcgccctttcactacttctatccaacattttcctggacattctggccagtgcagtcaaacaataaattataattaaaaagcacccagattggaaaagaagaagcaaactatctttattcacaggtgacatgatgacatatgtagaatatctaatggaatttaaaagcattttttggaactagtaagtgaagttagcagtgttgtaagatacaaaaccaatatagagaaatcaattgcatttttacaattgcaatgaataattgcattattttttaaaataaattttaaaaatactttattcagtagcatccaaaaatataaaatatgaataaatttacaactgaaacttcaaaacattgcttaaagagatgaaaaacctaaataaagggttaaatgtaccatatccatgggtcaaaagactcaatattgttgagatgttggttctccctagattgctttaaattcagtataatctcaataacaatccaagccagctttttatgtagaaattaacaagttgactttaaaattcatacataaatcccaggacagagaataaacaaaacaaactttgaaaaattggaataaagttagaaagcatatttgttctcacattgctatgaagaaatacccaagactgggtaatttataaaggaaagaggcttagttgactcacagttccacattactggggaggcctcaggaaacttacagtcatggtggaagacaaaggagaagcaggcaccttcttcacagggcagcaggatggagtgagtgcaagcaggggagaggccagacacttataaaaccttcacatctcgtgagactcactcattattcacaagaacaggatgggggaaactgcccccatgatccaatgacctccacccactcatgcccttgacacgtggggattatggggatttcaattcaaagtgagatttgggtggggacatagagccaaactatatcagaagtctgacaatacctgatattaaaactcataagagtacagtaatcaaaactgtgatgttgatcaaatgttcaacatgaagactatcattaataatattgcatagtgtactagaaaatttgctttcaaggcacacacacatacacacacacatacacacacatatgcacaaaggggtaaccgtgaaatgatgaataagctaatgtgcttgactataataaccatttcactatgtataagtgtatcagaacatcatatcatataccttaatatatacaataaagtagtttttttaatgtagagaattagatcaatgaaacaaattggaaagttaagaaatagttcacatatgtggacaactggtcttcaataagcatacaaaagtaattcagtgcaaaaaataatcttttcaacaaattgtgggataattggattttcatatgcaaaagaaatgaactttggtttacatctcactcatatgcaaaaattaccttaaaatggatggtatccctaaatataaaacctaaagctaaaaaagtcttctagaaaaaaacacaggagaaaatctttttattttatttttattatttttttttatttccgtaggttattggggtacaggtggtgtttggttacatgagtaagttctttagtggggatttgtgagattttggtgcacccatcacccgagcagtatacactgaaccctatttgtagtcttttatccctgagtcctcaaagtccattgtgtcattcttctgcctttgcatcctcatagcttagctgccacttataagtcagaacatacgatgtttggttttccattcctgagttacttcacttagaataatagtctccagtctcatccaggtcgctcaaatgccattaattcatgagaaaatctttttaaccttgtcttaggaaaagattttctagacatgataccccatgaacaatccataaaagaaaaattaataaattggacttcattaaaaacttaaactgctttttgaggatagtgttaagagaatgaaaagataaactgcaagttggaagaaaatactgcaaatcatatatctggtaaagtacttgtttctagaatatgtaaagagttctcatgactcaattatttttgtaaaaactatccaattaaaaataagcaaaagctttgaacagacttcaccaaagaagatacatggatagcaaataagcaggtgaaaagatgctcaacatcattaatccttagggaaatgtaacttaaagccagaatgagatagcactacacacctatgagaatgactaaaaccaacaatactgagcataccaaatctcagcaaggatgtggaaaaactggtaaatttgtacgctgctggttttgaatggaaagtggtgcagccactttagaaaacaattcagcaagttcttcaaaattagacatgtacctagtgtacaatccagcaaattttactcctatttatttacttaagaaaaccgaaagcctttgcccatagcaaagcttgtacacagatgtttttggcattcttagtgagggctaaaaaactggaagcaacctaaatacccatcacaggtaaacgggtaaacaaatggtggtagatacatacactggaatgctactcggctctcaatccaaaggagtgaattattgataacgtgcaacaacagagatgactctcaaaataattacatgaagtgaaagaagtgagacaaaaaaaaactacatattgtgcaattccacttatgtaaagtctaggaaatgcatagtgatctatagcgatggaatgcaggtcagtgattgcctcagacagggctgagggcagcagtgagcagtggggattacaaagcagctgaggaatcttttttttttttagacagaggctggagtgcggtggcgcgagctcgtctcactgcaagctctgcctcccgggttcacgccattctcctgcctcagcctcccgagtagctgcgactacaggcacccgccaccatggctggctaattttttgtatttttagtagagatggggtttcaccgtgttagccgggatggtctcgatctcctgacctcatgatttgcctacctcggcctcccaaagcgctgggattataggcgtgagcgaccgcacctggcctgaggaatcttttgagagtggtatatatgtatggtatcttgcagtgataacagacctcagaggtattgcagattcagttccagaccactgcaataaatatagcaataaagcaagtcacatgaattttttggttttctagtgcatatagaaattatgttggctaagcacagtggctcacacctgtagtcccagcactttgagagccaaggaggacggatagcttgagcccagagttccagaccagcttgggcagcatggtgagacctcgtctctattgaaaaaaaaaaaaacaaaaacctacaaaaatcagcctggtttggtggtgcatgcctgtcgtcccagctactggggaggctgaggtgggaggattgcttgagtcgaggagacagaggttgcagtgagtggaaatcacgccactctactccagtctgggtgacagagcaagaccctgtctcaaaaaaaaaaaaaaaaaaagttatctttatactattctgtagtctactaagtgttcaatagcattatatctaaaaaatgtacataacttaatttgaaaaaatactttattgccaaaaatgctaacaatcatctgagccttcagtgagtcataatctttttgctggtggagggtcttgcctcaatgtttatggctgctaactgatcagggtggtgattgctgaaggttggggtggctgtgacaatttcttaaaataagacaatcgtgaagtttgatgcatttaattgactcttcctctcatgaaagatttctctgtagcatgtgtgatgctatttgatagcattttacccacagtggaacttctttcaaaattgaagtcagtcctctgaaaccttgctgctgctttatcaaatgcattttgtaatttctaaatcctttttgtcatttcagcagtgttcacagcatctttaccaggagcagattccatctcaagaaaccactttccttgctcatccataagaagcaactccccaacttgagattgtagcaatttagtcacatcttcagactccacttctaattccagttctcttccaccacatctgcagttaattcttccactgaagtcttggaccccacaaagtcatccatgagagttggaatccatttcttacaaactcctgttaatgttgataatttgaccacctcccatgaatcacagatgttcttattgacttctagagttgtgaatcctttccagaaggttttcaatgtactttgcccagatctatcagaggaatcactatctatggcagttatagccttataaaatgtatttcttaagtaataagagttgcaagtcaaaattgctccttgatccgtggagtacagaatggatgttgtattagcagacgtgaaaacattgatcttgtacatcttcatcagagctcttgggtaactaggtgcattgtcaaatgagcagtaatattttgaaagaaatctttctttctgagcagcatgtctcagcaatgagcttaaaatattcagtaaaccaaggtatcaacagatgtgctgtgcccaggcttctttgttcctatagagcacaggaagagtagatttagtgtcattcttaagggcactagaactttcagaatgataaatgagcattggtttcaacttaaagtcaccagctacaattgtccctgtctgtagaagctttgaagccaggcagagacttattctcatctagcctagataacatcttcttccaatagagggctgtgttgtctacattgaacatctgttgtatagtgtagccaccttaatcagcgatgttagctagatcttctaagatctagagatcttgctgcagcttctccatcagcacttgccacttccccagtgcaataacatgaaacttttatgttattgaagatggcttttttccttaaacctcatgaaccagcctctgctagcttctaacttttcttctgtagcttcctcacctctcttagcctccgtagaattgaagagagttagggtcttgctctggattaggctttggcttaagggaatattgtaactggtttgatctatccagaccacagaccactgaaactttctccgtatcggcaataagactgtttcactttcttatcatttgtgtattcactggagtagcactactaatttctttcaataattattcctttgcattcaaaagttagttaactgtttagtgtaagaggcctagcttttggcccatcttagcttttaaaatgccttcctcactaagcttaaccattcctagcttttgatttaaagtgaaacatgaaattcttttttttttccatttgaacaacttgacattttagggttgttaatagcctaactttaatatgttgtgtctcagggaatagggaggcctgaggagagggagacaggagaatcactggtcagtggagcagtcagaacacacacaacgtttattaagttcatcggtatgtgtgggtgtggttcgtggtgccccagaaccagaactgttgtaattacaacagtaacatcaaagatcactgagcacagatcactataacagatataatcctaatggaaaagtttgaaatactgtgagaattcccaaaatgtgacacagagatgcacagtgagtgcatgctgtttgaaaaatgatgccaataaacttgctcagcacagggttgccacaaacctttaatttgtaaaaagaaaatgcagtatcttcaaagggcaatacagtaaagcacagtaaaatgaggtgtgtctgtatggacacgtgtcagcttctcaaattataaacttaaatatgtgcattttatttggtgtcaattgtataaagcgattaaatttttaaaaggactgatgcagacagcacctggcgtctgggataaggtgtatcattttcctctttatggcaggaactgccacgccccctgttttcatgctgccggagaccagctggcaagtggggggcagtggctctccttgccaatcctgggcatgcaggtgacagtgcagggagagtgcccttcccacatggcccccgtttgtagccacagctgtccctacaaaaactgggcagcctgaagtgaattaacaagacagttttcagatcttcacttgcttgtgggtttcacatgtcacatttaacctccagttacatcgactttttcaaaccccacttaggcatcttagaattttatcatttgcattcttttatgttgaataagagagttgtagtacatgccccactgtctgctttctaaaacatccaggttggagttagcgccttcatacaccctccctggaagcaccaggtgccatcctcagtgcagcggcaaggcagtgtcggggctctctgcccccaggtctctccccgcctggttccattggctgctgggaaggatgcttggatgggaggtctttgtgttttcaggcaggaaatattatttgctccgctagccctaggtcttactaatttactgtgcaatcttcaacaagtttcttgatcttcttgctctgttttctcatctgtaaaattgagggcagtgagcaaggtgacctgtaggtcccaggagcaccaaggtagtgccgtatttagtaccaggttttcctaagaggaaatgggggctacttggggtcaaaacaaaggagagtctttctagatagggaaggactagcagtgggtcaaaacttgccaagaaggactatgaatggagctttgcttggggtttaaaagcttcagtcacagacttggaggggctcaaaccccttgctttagaaggcagaaaccaagaaccactaaggacctaggacttgctgatggtgtctttggagtttaaggtggaactgaagttagagctgatttccttcctgtcacatccagtaagactgggaatggttgggtgccagaggcaggttccagaaggtgggaagagtcctgtctgcgtccccagggtcccaaccttgaggaaagcttgctgtccttctgtcctgcttcacactccctttggttaaaggtttcagtcagagcccgatagaaaccttcaggaaaaaagggccccagactgaggcgaggacactggggaagccttgggcggtttctgtgtggggcagcccctgctctgtgaagcacaggggaacgggactccatcgctgtcatcggcactcatgccctggtgcagacctgcaggaacattgcctgctgtatacagggcagatgggcactgtgccgggagaagcctgtaggaagggaggccttgagggataaggagggaactccggccatgagcatgcacagagctccgtgaaggaaggccttgacagacagaggcatggtgggtggagacgggtggagaacatcccggcagaacacagagcacgtgctgtggcttgctggcagggacatgtatgctgtgtaaaggcagggagtaggtccaggtgccctgggaagagtgtgtgtagagaaacgtcgtggaagaggagacacccaacgcgaggtcatggctggtttgcttgctgtgtttaaactgccatagactggcttttgtcagcagtggcagagagagggggttgcatttttctctttttagtttgcttttgaggtctccctctctctgtagagtggctgtgaagtccagccctgccctgacggggctccaggggaggtggttgtgcatgtttatgatgtgccttcacggggtacttctttatcctggtggatggcagaatccctgtgtctgacctgtgcccaggtctctcctgggagacttgtttaccctcttagacacccttgagtctcttgtctgtgtctggtgtatttatttatttagcctaccaagatagccactctttaggacagttctgaatttggaaagaagttaggttcaggtgtgtcggtcgagtgagacacagaggaggccactcaacaaaacctatgaaataccagaagcagtgagttcctcgcaggtccggagagaagagggcagcacgctggactaggggagccgtcaggacctgtgtgctcgctagcgggtggggagcaagatagatggagtgtgggctctgagggctgaagcctttatggggtccaggccatcaccccagcaggttccccacaaggagttgtaattcgttgggttagagcaggtaggcacaagttacaggaggccatgctgtgagtgaagggtggtcatggcagcatatctgagcagtccatgctgggtgtgagggtctgcagggtgggtcaagtaggttgcatctagctgtcccttagggacttggtcaccaggaggcagctatataaggcacatctctggatcgaccattttgagggcctgggaagaggtggagacctggaaactttcaaggatgactaagccctgcttctggtatgagaaagtccaacatacattcaaaataggtaccaagaaagcataacattataagaattcactgcagaggatcatctgaaaggtctaaggtgagaaatgaatatctagtgtagaagttggagaggcatccataggaatgatctctaatgaactggatctccctccaagatagagatcaaaattggtttaaaacaaatacaggggggtggagccaagatggccaaatacgaacagctctggtctacagcttccagcgtgagcaacacagaagacgggtgatttctgcatttccatctgaggtaccaggctcatctcactagggagtgccacacagtgggtgcaggacagtgggtgcagcgcactgtgcgtgggccgaagcagggcaaggcattgcctcactcgggaagctcaaggggtcagggaattccctttcctagtcaaagaaaggggtgacagacggcacctggaaaatcggttcactccaacctgaatactgtgcttttccaacgggcttaaaaaacggcacaccaggagattatatcccgcatctggctcggagggtcctacgcccacggagtctccctgattgctagcacagcagtctgagatcaaactgcaaggtggcagtgaggctgggggaggggcgcctgccattgcccaggcttgattaggcaaacaaagcagccgggaagctcgaactgggtggagcccaccacagctcaaggaggcctgcctgcctctgtaggctccacctctgggggcagggcacagacaaacaaaaagacagcagtaacctctgcaaacttaaatgtccctgtctgacagctttgaagagagtagtggttctcccagcacacagctggagatctgagaacgggcagactgcctcctcaagtgggtccttgacccccgagcagcctaactgggaggcacccccaagtgggggcagactgacacctcacacggccaggtactcctctgagacaaaacttccagaggaaagatcaggcagcagcatctgtggttcaccaagatctgctgttctacagccaccgctgttctacaggcaccgctgttctgcagccaccgctgctgatactgaggcaaacagagtctggagtggacctctagcaaactccaacagacctgcagctgagggtcctgtctgttagaaggaaaactaacaaacagaaaggacatccacaccaaaaacccttctgtacgtcaccatcatcaaagaccaaaagtagataaagccacaaagatggggaaaaaacagagcagaaaaactggaaacactaaaaagcagagcacctctcctcctccaaaggaacgcaccttctcaccagcaacggaacaaagctggacggagaatgactttgacgagctgagagaagaaggcttcagacgatcaaactactctgagatacaggaggaaattcaaaccaatggcaaagaagttaaaaactttgaaaaaaaactagatgaatggataactagaataatcaacgcagagaagtccttaaaggagctgatggagctgaaagccaaggctcaagaattacgtgaagaatgcagaagcctcaggagccgatgcaatcaactggaagaaagggtatcagtgatggaagatgaaatgaatgaaatgaagcgagaagggaagattagagaaaaaagaataaaaagaaatgaacaaagcctccaagaaatatgggactatgtgaaaagaccaaatttacgtctgattggtgtacctgaaagtgatggggagaatggaaccaagttggaaaacactctgcaggatattttccaggagaacttccccaatctagcaaggcaggcaaacattcagattcaggaaatacagagaacgccacaaagatactcctcgagaagagcagctccaagacacataattatcagattcaccaaagttgaaatgcaggaaaaaatgttaagcgcagacagagagaaaggtcgggtaacccacaaagggaaacccatcagactaacagctgatctcacggcagaaactctacaagccagaagagagttggggccaatattcaacattcttaaagaaaagaattttcaacccagaatttcatatccagccaaactaagcttcataagtgaaggagaaataaaatactttacagacaagcaaatgctgagagattttgtcaccaccaggtctgccctaaaagagctcttaaaggaagaacttaacatggaaaggaacaactggtaccagccactgcaaaaacatgccaaaatgtaaagaccatcaaggctaggaagaaaactgcatcaactaacgatcaaaataaccagctaacatcataatgacaggaccaaatacacacataacaatattaactttaaatgtcagtgggctaaatgctccaattaaaagacacagactggcaaattggataaagagtcaagacccatcagtgtgctgtattcaggaaacccatctcatgtgcagagacacacataggctcaaaataaagggatggaggaagatctaccaagcaaatggaaaacaaaaaaaggcaggggttgcaatcctagtctctgataaaacagactttaaaccagcaaagatcaaaagagacaaagaaggccattacataatggtaaagggatcaattcaacaagaagagctaactatcctaaatatatatgcacccaatacaggagcaccaagattcataaagcaagtcctgagtgacctacaaagagacttagactcccacacattaataatgggagactttaacaccccactgtcaatgttagacagatcaacgacacagaaagttaacaaggatacccaggaaatgaactcagctctgcagcaggcagacctaatagacatctacagaactctccaccccaaatcaacagaatatacatttttttcagcaccacacctattccaaaattgaccacatagttggaagtaaagcactcctcagcaaatgtaaaagaacagaaattataacaaactgtctctcagaccacagtgcaatcaaactagaactcaggactaagaaactcactgaaaaccactcaactacatggaaactgaacaacctgctcctgaatgactactgggtacatcacgaaatgaaggcagaaataaagatgttctttgaaaccaacgagaacaaagacacaacataccagaatctctgggacacattcaaagcggtgtgtggagggaaatttatagcactaaatgcccacaagagaaagcaggaaagatccaaaatcgacaccctaacgtcacagttaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagactgctagcaagactaataaagaagaaagagagaagaatcaaatagacacaataaaaaatgataaaggggatatcaccactgatcccacagaaatacaaactaccatcagagaatactacaaacacttctacacaaataaactagaaaatctagaagaaatggataaattcctggacacatacaccctcccaagactaaaccaggaagaagttgaatctctgaatagaccaataacgagctctgaaattttagcaataatcaatagcttaccaaccaaaaacgtccaggaccagatggattcacagccgaattctaccagaggtaaaaggaggagctggtaccattccttctgaaactattccaatcaatagaaaaagagggaatcctccctaactcattttatgaggccagcatcatcctgataccaaagcctggcagagacacacacaaaaaagagaattttagctgaatatccttgatgaacattgatgcaaaaatcctcaataaaatactggcagaccgaatccagcagcacctcaaaaagcttatccaccatgatcaagtgggcttcatccctgggatgcaaggctggttaaatgtacacaaatcaatagatgtaatccagcatataaacagaaccaatgacaaaaaccacatgattatctcaatggatgcagaaaaggcctttgacaaaattcaacaacccttgatgctaaaaactctcaataaattaggtattgattggacatatctcaaaatattaagagctatctatgacaaacccacagccaatatcatactgaatgggcaaaaactggaagcattccctttgaaaactggcataagacagggatgccctctctcaccactccgattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcaacaaagtctcaggatacaaaatcaatgtgtaaaaatcacaagcattcttatgcaccaataacagacaaacagagagccaaatcatgagtgaactcccattcacaattgcttcaaagagaataaatacttaggaatccaacttacaagggatgtgaaggacctcttcaaggagaactacaaaccactgctcaatgaaattaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttgatatggaaccaaaaaagagcccgcattgccaagtcaatcctaagccaaaagaacaaagctggaggcatcaccctacctgacttcaaactatactacaaggctacagtaaccaaaacagcatggtactggtaccaaaacagagatatagatcaatggaacagaagagagccctcagaaataatgccacatatctacaaccatctgatcttcgacaaacctgacagaaacaagcaatggggaaaggattccctatttaataaatggtgctgggaaaactggctggccatatgtagaaagctgaaactggatcccttctttacaccctttacaaaaattaattcaagatagactaaagacttaaacattagacctaaaaccataaaaaccctagaagaaaacctaggcaataccattcaggacataggcacgggcaaggacttcatgtctaaaacaccaaaagcaatggcaacaaaagccaacattgacaaatgggatctaattaagctaaagagcttctgcacagcaaaagaaactaccatcagagtgaacaggcagcctacaaaatgggagaaaatttttgcaacctactcatctgacaaagggctagtatccagaatctacaatgaactcaaacaaatttaaaagaaaaaaaacaaacaaccccatcaacaagtgggtgaaggatatgaacagacacttctcaaaagaagacatttatgcagccaaaaaacacatgaaaaaatgctcatcatcactgaccatcagagaaatgcaaatcgaaaccacaatgagataccatctcacaccacttagaatggcgatcattaaaaagtcaggaaacaacaggtgctggagaggatgtggaaaagtaggaacacttttacactgttggtgggagtgtaaactagttcaaccattgtggaagtcagtgtggcgattcctcagggatctagaactagaaatatcatttgacccagccatcccattactgggtacatacccaaaggattataaatcatgctgctataaagacacatgcacacgtatgtttattgcagcactattcacaatagcaaagacttggaaccaacccaaatgtccaacaaccatagactggattaagaaaatgtggtacatatacaccatggaatactatgcagccataaaaaatggtgagttcatgtcctttgtagggacatggatgaaactggaaaccatcattctcagcaaactatctcaaggacaaaaaaccaaacactgcatgttctcactcataggtgggaattgaacaatgagaacacatggacacaggaaggggaacatcacactccggggactgttgtggggtggggggaggggggagggatagcattaggagatatacctaatgctaaatgacgagttaatgggtgcagcacaccagcatggcacatgcatacatgtgtaacaaacctgcacattgtgcacatgtaccctaaaacttaaaagtataataataataataaaagaagttgccatagccaccctaaccttcagcaactaccagcctgatcaatcagatgccatcaacgtggaggagagaccccccattagcaagattacaacttgctgagggctcagatgattgttagcacttttttttttaacaataaagtaatctttaaggtgtaaaaaagaaaccataaaaacaaaaaaacaaaacaaaaaaaaaacaaatataggccgggtgcagtggctcacacctgtaattccagcactttgggaggccaaggcaggagaatcacttgaggcgaggagttggagcccagcctgggcaatatagtacaaccctgtctttactaaaaatacaaaaattaaccaggtatggtggcacacacctgtagtcctggcaactgaggaggctgaggcaggagaatcatttgaacccaggaggtcaaggctgcagtgagctatgattgcaccactgcaatccaacttgggcaacacagtgagaccctgcctcaaaaaaaattatattctgattttctgagtccatgaacacattgtccaaatggatttttctagctcctccaagttacagatagttccatgcacacacagaacccaccactctcaaatattttccccactagtatactattaaatttttcaaacatgcaaaagatgaaagaattgctcaatgaacaccatgtacccaccacctagattctacaattaacattttaccctactttctttgtcacatatatgtacctatccatctacccattcttccatgaatccatcaattcatctaattttttgtatatttcaaggtaagttgtagatacgtagcttacatttcaccttaaatgtttccgcctggctattattaactggagtgcaatatgtttttggttctttatggtaaaatctatgtgcaatgaaatgcacaagccttaggtatgccattaataggtattgacgaatagacacaccttgtgtctgaaactgtaataaaaaaatcaaacactaccttcctttcaaaaagtttcctcacttcttttcttggtcaaaacccctccccacctcagcccacccctcagcaaccattgttctcaatttttttttgcattcctagattgattttgcttgttccataacctcgtataaatgaaagtgtacagtgtgcaaggtttgtgtctggtttttccaccaagcacatttctgaaattcatctatgttgagtatattagcagttcatttcttttgaagaaagaatgaagtgtgctaagtagtgtttcattgtgtggctataccacagtttgtttttttatccatcactatttaatgggtatctgggtggtttctggctttggctactatcagtaaagctactacagacatttctgtagaagtctttttatggagatgtggctttgcttttcttgggtaaacacctatgagtgaactctctggatcccaggtagatgtagctaggtcataggcagatgtatgttgagtattacagaaactgctagaccttttcaattgtgttcatattgttttatactcccactgtaacaacatacgagagtcctgcttgctccatcatctttgatgtttagtgttgtcagtctttttaactttagccattctggtgcatttgtatgtcattccattgcagttctttttttttttttttaaatcaggaatgtttagtcgaagtctgatattgtggtgtactagtcatctattgccgcatacaaaaatcatcccaaaatttagcagcctaagataaccatcatatatttcttacaccatttctgaggctcataaatccaagcgtggtgtaactggctcagggtccttctcgaggctacagtctagctggggctgcaggaccttcttccatccccactcgcagggctgctggtggcctcaattcttcactggcggtcagcaggagacctcagagcctcaccacagcctcttccctggctgcctgggcaaccttgtaaagcatcagttgacttccctcagagtgagtgatgagggagagataaagcgacagcttatggtggaagccacagtgtgtcatggagtaatctcggaagtgacatcccatcacataggctataatccatcggtcatacagactaaccctagtacaaagtggagggggccacacagagggatccttgggggctatcttggagggtggccaccccgtggggagaaggtggaagcagccacctcagggaggcagattgtaatcaggacccataggagcagcatggagcccatgtgtttctgtgcagtttgctgaagccagtcagaacatcctgagtctgacttatcacccttctctggcctgctggggttcctgaaccaagtagtttaacttgccaagccttagtttctgcagttataaaatggtggtatgaatgaatgaaacaaggtatccgcaacactgaaatggaacataatagggcctgaacagaggacagttatgaatatttccatacaaaatgcaattttatgcccttcatcaatggtcattttctctcattttacttttgaggactagatttgccaaagtccctctggggccaacccagtacaccactgagaagccctttgaaaaagccagctttatcatcgttttgtttttatttcttgatatttggaaagttttcttccttctgtttctatgtgtcctctgcctaactagtcatggtgactccttggatagtattctccatggtttcttgtgaaatattaatgcttaccttgcaatcttgcagcttttagcatgaattattttgctgattataatcaggcctctaggataagtaccactgattttaatttaatgttaaatttgtactgagtgaatcataatggtcagactaatctaaatggtgcaggtatataaaactacatgcccatgtgctcagttcctgcttgttgatgttttgttataaagtaacagctttttaacatcaaatgtattccaagtagccactttacagtgacactgcaaaacctactacaaagcaaagccaataagacaaagtcaaaatatttcaaagtttcttattgaagtattgcatacctctagaaattacaacataactgtacaacttaatgaattctcagaaaatgtagcatcagtgcaaatatcattgaaatcaaatcggtggggcagttccaagttggccgaataggaacagctccagtctacagctcccagcgtgagcgatgcagaagacaggtgatttctgcatttccaactgaggtaccgggttcatctcactggggcttgtcagacagtgggtgcaggacagtgggtgcagcgcaccgagcatgagccgaagcatggtgaggcatcacctcacccgggaagtgcaaggggtcagggaattccctttcctagacaagcaaagctgtcacagatggcacctggaaaatcaggtcactcccaccctaatactgcgcttttccaatggtcttagcaaatggaacaccaggagattatatcccacgcctggctcggagggtcccacgcccacggagcctcgctcattgctagcacagcagtctgagatcaaactgcaaggcggcagtgaggctgggggaggggcgcccgccattgctcaggcttgagtaggtaaacaaagcggccaggaagctcaaactgggtggagcccactgcagctcaacgaggcctgcctgcctctgtagactccacctctggggacagggcatagctgaacaaaaggcagcacaaacctctgcagacttaaatgtcccagtctgacagctttgaagagagtagtggttctcccagcacggagtttgagatctgagaacagacagactgctttctcaagtgggtccctgacctctgagtagcctaactggaaggcacccccgaagtaggggcagactgacacctcacacggctgggtacccctctgagacgaaacttccagaggaaagatcaggcagcaacattcgctgttcagcaatattcgctgttctgcagcctctgctgctgatacccaggcaaacaggttctggagtggacctccagcaaactccaacagacctgcagctgagggtcctgactattagaaggaaaactaacaaacagaaaggacatccacaccaaaaccccatctgtacgtcaccatcatcaaagaccagaggtagataaaaccacaaagatggggaaaaaacagagcagaaaaactgaaaattctaaaaatcagagtgcctctcctcctccaaaggaacgaagctcctcaccagcaatggaacaaagctggacggagaatgactttgacgagttgagagaagaaggcttcagacgatcaaacttttctgagctaaaggaggaagttagaacccatcacaaagaagttaaaaaccttgaaaaaagattagacgaatggctagctagaataaccaatgcagagaagtccttaaatgacctgatggagctgaaaaccatggcatgagaactacgcgacgaatgcacaagcttcagtagccaattccatcaactggaagaaagggtatcagtgattgaagatcaaatgaatgatatgaagcaagaagagaagtttagagaaaaaagaataaaaagaaacaaacaaagcctccaagaaatatgggactatgtgaaaagaccaaatccacgtctgattggtgtacctgaaagtgagggggcgaatggaaccaagttggaaaacactctgcaggatattatccaggagaacttccccaacctagcaaggcaggccaacattcacattcaggaaatacagagaacaccacaaagatactccttgagaagagcaactccaagacacataattgtcagattcaccaaagttgaaatgaaggaaaaaatgttaagggcaaccagaaagaaaagtcgggttacctacaaagggaagcccatcagactaacagctgatctctcggcagaaactccacaagccagaagagagtgggggccaatattcaacattgttaaagaaaagaattttcaacccagaatttcatatccagccaaactaagcttcataagtgaaggagaaataaatcctttacagacaagccaatgctgagagattttgccaccaccagacctgccctacaagagctcctgaaggaagcactaaatgtggaaaggaacaactggtacagccactgcaaaaacatgccaaattgaaaagaccatcgatgctaggaagaaactgcatcaactaacgagcaaaataaccagctaacatcataatggcagtatcagattcacacataacaatattaaccttaaatgtaaatgggctaaatgctccaattaaaagacacggactggcaaataggataaagagtcaagagacatcagtgtgctgtattcaggaaatccatctcacatgcagagacacaaataggctcaaaataaagggatggaggaagatctaccaagcaaatggaaaacaaaaaaaaaggtaggggttgcaatcctagtctctgataaaacagactttaaaccaacaaagatcaaaagagacaaggccattacataatggtaaagggatcaattcagcaagaaaagctaactatcctaaatatatatgcacccaatacaggagcacccagattcataaagcaagtccttagagacctacaaagagacttagactcccacacaataataatgggagactttaacaccccactgtcaacgatagacagatcaacgaaacagaaagttaactaggatatccaggaattgaactcagctctgcagcaggcagacctagtagacatctacagaactttccaccccaaatcgacagaatatacattcttctcagcaccacgtcacacttattccaaaattgaccacgtaattggaagtaaaacactcctcagcaaatgtaaaaaaacagaaattatagcaaactgtttctcagaccacagtgcaatcaaactagtactcaggactaagaaactctctcaaaaccgctcaactacatggaaactgaacaacctgctcctgaatgactactgggtacatcacgaaatgaaggcagaaataaagatgttctttgaaaccaacgagaacaaagacacaacataccagaatctctgggacacattcaaagcggtgtgtggagggaaatttatagcactaaatgcccacaagagaaagcaggaaagatccaaaatcgacaccctaacgtcacagttaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagactgctagcaagactaataaagaagaaagagagaagaatcaaatagacacaataaaaaatgataaaggggatatcaccaccgatcccacagaaatacaaactaccatcagagaatactataaacacctctacacaaataaactagaaaatctagaagaaatggataaattcctggacacatacaccctcccaagactaaaccaggaagaagttgaatctctgaatagaccaataacagtctctgaaattgaggcaataatgaatagcctaccaaccaaaaaaagtccaggaccagacagattcacagccgaattctaccagaggtaaaaggaggagctggtaccattccttctgaaactattccaatcaatagaaaaagagggaatccttcctaactcattttatgaggccagcatcatcctgataccaaagcctggcagagacacacacaaaaaagagaattttagactaatatccctgatgaacatcgatgcaaaaatcctcaataaaatactggcagaccgaatccagcagcacctcaaaaagcttgtccaccatgatcaagtgggcttcatccctgggatgcaaggctggttcaacatacacaaatcaataaatgtaatccagcatataaacagaaccaaagacaaaaaccatgtgattatctcaatagatgcagaaaaggcctttgacaaaattcaacaacccttgatgctaaaaactctcaataaattaggtattgatgggacatatctcgaaataataagagctatctattacagacccacagccaatatcatactgaatgggcaaaaactggaagcattccctttgaaaactggcacagacagggatgccctctctcaccattcctattcaacatagtgttggaagttctggccagggcagtcaggcaggagaaagaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtgtaaaaatcacaagcattcttatgcaccaataacagacagagagccaaatcatgagtgaactcccattcacaattgcttcaaagagaataaaatacctaggaatccaacttacaagggatgtgaaggacctcttcagggagaactacaaaccactcaatgaaataaaagaggatacaaacaaatggaagaacattccatgctcatggataggaagaatcaatatcgtcaaatggccatactgcccaaggtaatttatagattcaatgccatccccatcaagctaccagtgactttcttcacagaattggaaaaaactactttaaagttgatatggaaccaaaaaagagcccgcattgccaagtcaatcctaagccaaaagaacaaagctggaggcatcaccctacctgacttcaaaccatactacaaggttgcagtaaccaaaacagcatggtactggtaccaaaacagagatatagatcaatggagcagaacagagccctcagaaataataccacacatctacaaccatctgatctttgacaagcctgacaaaaacaagaaatggggaaaggattccctatttaacaaatggtgctgggaaaactggctagccatatgtagaaagctgaaactggatctcttccttacaccttatacaaaaattaattcaagatggattaaagacttaaacattagacctaaaaccataaaaaccctagaagaaaacctaggcaataccattcaggacataggcatgggcaaggactcatctctaaaacaccaaaagcaatggcaacaaaagccaacattgacaaatgggatctaattaaactaaagggcttctgcacagcaaaagaaactaccatcagagtgaacaggcaacatacagattgggagaaaatttttgcaatttacttatctgacaaagggctaatatccagaatctacaaagaactcgaacaaatttaaaagaaaaaaacaaccccatcaacaagtgggcaaaggatatgaacagacgcttctcaaaagaagacatttatgcagccaacagacacatgaaaaaatgctcatcatcattggccatcagagaaatgcaaatcaaaaccacaacgagataccatctcacaccagttagaatggcaatcattaaaaagtcaggaaacaacagatgctggagaggatgtggagaaataggaacacttttacattgttggttggactgtaaactagttcaaccattgtggaagacagtgtggcgattcctcaggtatttagaactggaaataccatttgacctagccatcccattactgggtatatacccaaaggattataaatcatgctgctataaagacacatgcacatgtatgtttattgaggcactattcacaatagcaaagacttggaaccaacccaaatgtccatcaatgatagactggattaagaaaatgtggcacatatacaccatggaatactatgcagccataaaaaatgatgagttcatgtcctttgtagggacatggatgaaactggaaaccatcattctcagcaaactatcacaagaacaaaaaaccaaacaccgcatgttctcactcataggtgggaattgaacaatgagaacacttggacacaggaaggggaacatcacacaccagggcctgttttggggtgggcggagggggcagggatagcattaggagatatgcgtaatgtgaatgacgaattaatgggtgcagcacaccaacatggcacatgtatacatatgtaacaaacctgcatgttgtgcacatgtaccctagaacttaaagtataataaaaaaattaaaaaataataaaataaaaataaaaaaggaaatcaaatcaaactgtgactatcagcagccagaaatctctttccttccctcttcctatcactgcaccttctttctccccagaggtaactagaactacagtcatgacttctaacaccttaggttagtctttcctgtgcttaagctttgtatacatggaatcatgcagtatatattcctgtgtatctgccttcttttgcacatagacacatagatataaatgtatataagtcttgccagagttatcagttatctttttttcttttttttttgacatggagtctcactctgtcaccaggggagtgcagtggcacagtctgggctcactgcaacctctgtctcccgggttcaagcaattcttctgcctcagcctcccaagtagctgggactacaggcacctgccaccacggccagctaatttttgtatttttagtagagacggggtttcaccatgttggtcaggatggtctcaatctcttgacctcgtgatccatccacctcggcctcccaaagtgctgggattacaggcgtgagccactgcacccggccaagttatcgattattctaagtctttccaaagaaccattttttggcttcatcgattctctttatcatttgtcgtctgttccattaaaatctgatgttatcctcataaatgtttgatatatttggttgtagatctaccctctcagcatttgtgagttcttttcttggtcttgttgtttctccttttttccttctttatttgttggttaaatttgctatttcttaaaactgtttgagatcggtactcagatcaggggttggcaaacttctttccatggcaggacagatagtaagtactttgggctttgcaagctacacatgcttcctgtcacatattctttcttttaaacttaaaatgtaaaagctggttgggcacggtggctcatgcctgtaatcccagcactttgggaggccgaggtgggcagatcacctgaggtcaggagttcaagaccagcctggccaacaaggtgaaaccccgtctctactgaaaatacaaaaattagccaggcacagtggtggttgtctgtaatcccagtactcgggaggctgaggcaggagaatcgcttgagcctgggaggtggaggtttcagtgagccaagattgcgccactgcactccagcttggagacagagcaagactctgtctcaaataaatgaataaaagtaaaatgtaaaagctattcttagtttatgcattgtacaaaaacaggggcagagtggaattggcccatgggtcataatttgcaaacccccaacttagattgttgaggcccagcctcttcttttcacatatatatataaatggttatacatttccagttaattcctcagcatgtaaggattttccacttctctttctgttattgatttctgtcaagcgcacacaccagacaaggcaagagcaaggtctgcctgattcaaccagtaaggatgcgacaggccagttttagatgcagacggtttattacttacatagacagcaaaggagagagtagccaaggtgccagctcccaggtccttgtttcacatgccagaaagcatgacactgaaacaaaagggatggagtgctgcatgagttgtgcaagaccccattgctggggagcctgttctgcgctgcagctaagaggtttcaccgctttattacagttttattttcattcatgtctaccatcctgagggggtgggagaagaaaggcccatacctcatcagaacagtgaggccaggtggagctgtctgatgactgccttgcaggggagagagaaggtgagggagagatgtcctcagagcagtgcctgacagacctcccatctgcccctgtgccagaaggatcccaaggcattctgccaagactcagaccgcggttgaagcctgtgcctgtggggtctctgttggtacctggaaggtcacctgggcacggtggcacagccagtcccctacaattccctgtcctcttccagttggtcagagaagagagtctgaatgatttcagccttttgaaatttgggacttgctttatggcctagcatatgatcaattttggtaaacgttccatgttcacaaagaaacaaaaagtggattttgtgattcttggtgcagtgatctgtatatgttaattggatcgtatttttcatgtgatttaaatccatactgattatttttgtctgcttgttctatcagctactgacagcactttgttaaaacctccaactatgatcgtggacttgtatatttctctttattttctgtcgatttttcctttatataatttgaagttaagaatagacttgtcatagcttcctgtaggactgatattttattataaacttttttctgtcattactaaagttttattttcattaacgtcaacttgtctgacattggtttttctacattagctcttttgattagtgtttgcatgatatatttttaaaatcattctactttcaacctttgtgacagtttgtgattcagatgtaagcaatgtaaaattaaggttttttaaatccagtctgatcatctgttttttacttgaagcattttagtttacctacattggatgtgataactgatctagttggttatagatctaacatctcattatttgcttttgtttgccctgtcatttcctttttcatctttcctgcataattttgtataaatcaaagtatttattaatgttctattctattagcttcttcccggtacattcctttactattcttttggtagttacgatagaggttacgatatacatccttgactatcgagtttcccttaaaatagtacttgtaccatactttggacaattcaaggaacttagtacttctgaacaccatttagccccttctgccttgtatattaatattgtcccataatttgattctctttcaaattccgtagggcaacgttattttctatagggtcaatacccacttggctataatgattttccgttgttctttattttttcctgtagctctgagcttcaatctgagattatttccttctacctaaagaacaccttttagtattttctatagtgtggtcccctggtgataagtgtctgaaatttttttttattttgcatctgcttttaaagaataattttacaagatataggactgtagactggcatttatgtatgtatttacttatttttgaactctgaagatattccattttcttctggcctttattatttccatttaaaagtcaaggtagtcttttttcttatactgtttctaaaatattttcctttatcataggttttcagcagttttattataacatgcagacttgcatttttcttatatttatgctccttggggttcataccacttctggatctgtggcttgatatctttcactaattttagaaaattctcagtcattgtctttttttttctatttttccataggttattggggtgcaggtcgtgttcggttacatgagtaagttctttagtggtgatctgtgagattttggtgcacccatcacctgagcagtaatacactgcaccctatttgtagtcttttttcccttgccctcctcccattcttcccccaagtccacaagtccattgtatcattcctatgcctttgtgtcctcttagcttagctcctacatatcagtgagaacatatgatgtttggtttttcattcctgagttacttcacttagagtaatagtctccaatcttatccaggttgctgcgaatgcctttgattcattcccttttatggctgagtaatattccattgtgtatacatatatatatacaccacagtttctttatctactcattgattgatggacatttgggttggttccacgattttgcagttgtgaattgtgcagccacaaacatgcatgtacaagtgtctttttcatataataacttcttttcctctaggtggatacccagtagtgagattgctagatcaaatggtagttctagttctttaaggaatctccatactgttttccatagtggttgtactagtttacattcccaccagcagtagaagtgttccctgatcactgcatccatgcctcaatctactgttttttgatttttttattatggccattcttacaggagtaaggtggtatcacattgtggttttgatttccatttccctgatcattaatgatgtagagcattttttcatatgtttgttggccatttgtatatcttcttttgagaattgtctgttcatgtccttagcccactttttgacgggattgtttgtttttttcttgctgatttgtttgagtttgggttctagattctggatattagtcctttctcaaatgtatagattgtgaagattttctcccactctggaggttgtctgtttactctgctggctgttccttttaccatgcaaaagctctttagtttaattaagttccagctatttatctttgtttttattgcatttgcttttgggttcttgctcatgaaatccttgcctaagccaatgtctagaaggggttttccaatgttatcttctagaatttttatagtttcaggtcttatatataagtcattaatccctcttgagttgatttttgtaaaaggtgagagatgaggatcctgtttcattctcctacatgtggctagccagttatcgcagcaccatttgttgaaaagggtgtcctttccccactttatgtttttgtttgctttgtcaaagatcagttggctgtaagtatttgggcttattgctgggtactctattctgttccattggtctatgtgcctacttttgtaccagtaccatgctgttttggtgactatggccttaaagtatagtttgaaatcaggtagtgtgatgcctccagatttgttctttttgcttagtcttactttggctatgcaggctcttttttggttccatatgaattttagaattgttttttctaattctgtgaagaatgacgatggtattttgatgggaattgtgttgaatttgtagattgcttttggcagtatggtcattttctcaatattgagtctacctatccatgagcatgggacgtgtttccatttgtttgtgtcatctatgatttatttcaccagggttttgtagttttctttgtagaggtctttctcctcctcagttaggtatattcctaggtattttatttttttgcagctattgtaaaaggggttgagttcttgatttgattatccgcttggtcactcttggtatatagaagagttaccaatttgtgtacattaatcttgtatccagaaactggtgaattcttttagcagttctaggagctttctggaggagtcttcagggttttcaaggtaaacaatcatattgttagccaacattgacagtttgacttcctcatcaccgatttggatgccttttatttctttctcttgtctgattgccctggctaggacttccagtactatgttgaagaagagtagtgagagtgggcatccttgtcttgttccagttctcagagggaatgctttcaacttttcccattcagtattatgttggctgtgggtttgtcatagatggcttttattacattgaggtatgtctcttgttgctgattttgccaagagttttaatcttaaaggatgctggatttgtcaaatgctttttctgcatctattgaaatgatcacatgatttttgtttttaattctgtttatgtggtgtatcacatttatcaacttgcatatgttaaatcgtttctgcattcctggtatgaaacccacttgatcatggtggattatctttttgatatgttgttggatttggttagctagtattttgttaaggattttagcatctttgttcagcaaggatatcggtctatagtttttcttttttggttatgtccttccctggttttggtattagggtgatgctggcttcatagaatgcatcagggagggtcccttctttctctatcttgtggaatagtgtcaaaagaattggtaccaattctttgtctggtagaattctgctgtgaatccgtctggtcctggacttttttttgttggtaatttttaaattaccatttcaatctccctgcttgttattggtctgttcagggtatctaattcttcctgatttaagctgagggttgtatttttccaggaatttatccatctcttctatgttttctagtatgtgagtaaagatgttcatagtagccttgaatgatcatttgtatttctgtggtgtcagttgtaatatctcccatttcatttcttaatgaggttatttggattttctctcttcttttcttggttaatcttactaatggtctgtcaattttatttatcttttcaaagaaccagctttttgtttcatttatcttttgtatttgtttgtttgtttgtttcagcttcatttagttctgctctgatcttggttatttcctttattctgctgggtttggctttggtttgttcttgtttctctagttccttgaggtgtgacctgagaatgtcagtttgtgctctttcagtctttttgatgtaggcgtgtagggctatgaagtttcctcttagcacctcctttgctatatcccagagattttgataggttgtgtcgttattgtcattcagcttgaagaattttttaatttccatcttgatttcatttttgacccaatgatcattcaggaataggttacttaatttccatgtgtttgcatggttttgaaggttccttttggagttgatttccagtttgattccagggtggtctgacagagtgcttaatataatttcatttttctggccgggcatggtggctcacgcctgtaatcccagcactttgggagtccgaggcaggcagatcacgaggtcaggagatcgagaccatcctggctaacacggtgaaaccccgcctctactaaaaatccaaaaatacaaaaaattagccaggcgtggtggcgggcgcctgtagtcccagctacttgggaggctgaggcaggagaatggcgtgaacctgggaggcggagcttgcagtgagccaaggttgcgccattgcattccagcctgggcaacagagtgagactccgtctcaaaaaaaaaaaaaaaaaaaaaatatatatatatatatatatatataatttcatttttcttaaatttattgaggcttgttttgtggcctatcatatggtctatcttggagaaagtcccatgtgctgttgaatagaatgtgtattctacagttcttggatgaaatgttctgtatatatctgttaagtccatttgttctaaggtatagtttaaatccattgtttctttgttgacttttctgtcttgatgacctgtctagcgctgtcagtggagtattaaagttccccactcttattgtgttgccatctatctcatttcttagatctattagtacctgttgtatagatttgggagctccggtgttaggtgcatatatggttaggattgtgatgttttccaggacaaggctttttagcattatataatacccctcctccatgtctcttttaactgctgttgctttaaagtttgttttgtctgatataagaacagctacttctgcttttgttttatcacattagcagagctgattttctggttccttctcatttggtaggctctgtcagagggaaggtctagagctgaaggctgttcagattcttttgtcccacagggtgttcccttgatgtagtattctccccctttcctgtgagctgagctgcagtgattgctatctctcttctgggtctagccatccagcaagtctgcccggctctgggctggtactgggggttgtctgcacaaagtcctgtgatgtgaagcatctatgggtctctcagcgatggatgccagcacctgttccagtggaggtggcaggggggtgaaatggactctgtgagcgttcttagctttggtggtttaatgttctgtttttgtgccggttggcctcctgacgggaggtagcgctttcgagagagcatcagctgtgctagtatggagagggaccagcagtgggtgggaccctagaactcccaagagtatatgccctttgtcctcagctaccagaggaggtagggaaggaccatcaatggggggcagggctaggcgtgtctgagctcagactctccgttgggtcttgctgtgctgcggctgctgtagggaatgggggtgaggttcccaggtcaatggagttgtgttcctgggaggattatggctgcctctgctgagtcatgcaggctgtcagggaagtggggcaattcggtagtcacaggcctcacccagctcccacacaatctgaagggccagtctcacttccaccgtgtgcctgctaacggcaccaagtttgtttcctggcagtgggcaagcaaagctgagaacttaccccaggctatccacctcccagatgcaaaagaaaagggctttagttcctccccatcctgtggaggctacacgtcagattcgcgccttcccctgagttctggccaggaggctcttgcccagttcaaattgttaaaaagttcagcttgagacttccttttcctttgcctctgactgccccccgatccctgtggtgacaggcaagaatggcctgcttggggacccagtgagctcccagggcctttcccgctgcctcctctacccctgtatttcgctcagctctctaaattgactctgctccaggtaaggtcagaaacttctcccacaaactagaccttcagtttccccagtgagagtgtgtgtttgggggcagaggatttccctttcctgcttctgcagtttgggcactcccagtatttggggcatctaccaggtcctgcaggagcagtctgcttctttcagagggtctatagattcctggtttattcctgcagtcattctggatctaaaattcatgatgcgagcctccgcacgctgctctgttcttccaagttggagctacagtctagtcctgcctcatgtccaccattatcttttaaaatattgcttctatcccatcctgtatattcttcctttctggaactcagctacagctggtcactgacttatgatagttcaacttacgatttttcaactttataataggcacttacagtatttttgatttaggatgggtttgttgggacataactccatggcaagttgaggagcttctgtgcacatgtgtcaaaaagcccctttcccatgcttatgtgtatggtcttgtgcttttagctctcattccacacctccacctcccactgtgtgtctgtgtgtctgcatgtctgtaagtctgcttcaaacaatattttcttctgaacttatctttcactttatttattctcttttcttgattgcccagtcagctcttaaccatatgcaccgagttcttatttttagttcatctatttttcagttctagactggacttatttttatgtttctcaattcaattccctgccaaaattctttttttttcttctttgagatggagtctcagtctccaggctggagtgcagtgccacaatctcagctcactgcaacctccgtctcccgggttcaagcgattctcctgcctcagcctcccaagtagctgggactacaggcatgtgccaccatgcgcagctaatttttgtatttttagtagagacggggtttcaccatgttggccaggatggtctcgatctcctgacctcatgatccgcctgcctcagcctcccaaggtgctgggattacaggcatgagccactgcacccagcccaaaattctttaacatctaccatattaaatataattattttagactacagtcatgcatcacttaatgatgagatacattctaagaaatgcattgttaggcaacttccccattgtgcaaacatcacagagttcatttacacaaacctagatggtgcagcctactacacacctaggctatatggtatagcctactgttcctaggctacaaacctgtacagcatgttactgcactcagtaccgtaggtaattgtaacacaatactaagtatttgtgcatgtaatcctatataaatatagaaaaggtaatacattgcactagaacattatgtcaccttcaacatcactaggcaataggaatttttcagctccattttaatcttaagggaccactggtaattttaattgggtcttggatattatatattaagattttgagatataattttaggctatgggtgattttattttttttcctgagaaagtgaagtttgcttattttaggcaactggggtgaggacattagtaatccaaggccactttaagccaatcaggtatttaagtaatttgaagctggccttgattccctactatggctagtttgtttttagtttactctcactcttggggtatagcccttcaagttcccagccaaaagcctggggtgttggccaaggtttgttcttcattgagggccctgagtactagtttctatctgcccagatccataagacttgttaaaagctctcttcagctcctcagcctctcagccactgcttttgtcactggcaatattcccaatggggaaagtaactccaaatgctagtttatctctcttgtctctaatcctctcctagttctcagcttaacattcctcactgcctttatactctctgatgtcatcaaacagatctctttcttatattttgccatgtttcctagttattccagtgtcagtattgttgtaaaacaacctactccaccatttccagaagcgaaactccccagggcagtttgaatttgtttactgtgctatcactgataaacacttacttcattgctggaataagcggacagtagtagttttgtgtatgaaaatttttatgaaagaattctaaactgatttatatgatatataatgtcagcattatataactaatcttgaaataaaatgttattacttaactcacacatgaaaaaaagtgtttgtaaatattacccatttaatgcctagagggtatctggttttgccaattgaataaagggctgctgacttccaaaacagaagtcgtgcgttagacagttaatgtgacagatgttgacatcagctttgtagtgttacagtttacacagatgaatttggtgcaggatgtgtaattccattactgtctgacttagtacatatttgcagtatagggatttttttcaacgtcatgaacacagatgatctgctattgtttacattttactagtcatactaaaaaatccagttaactttgttattcatccatttctgactaatttattttaaacaactccaaaagccaccaatactaagaagtgactcccatgttgggaatgtaacatttttcaagctactaactctgtgcacggtcacgtgtgtgttcataacggaggcctctgaaacctacctcagttctgcaccacttcgtctctccctcccctgaggctaaagcatacctgccagagctttgcacatgaagatggtaaaatagttaaacaaagtttcacaacaaccctgcatatctagcaagagttgtttatgtgaaatataggttattctgcatttacactgagctaaaaattgcaagcaaagagcaactatgatggggatgtgaggccacatgcagatcactggatccaaaccagagacattggttgaaggtcatctagctgtttaattttggttgtggtaaattaggtttgtttttaataatgttcttctaaaatggaaactggactccaagagtatacagaaaggcctgttgatgttggcatttgtggtttccccacaggctccagcagaaatggttcactggttagaatgggagctctgtcctttgtcactccctgtccacgggcacagtggcacagtctccccggtggctggagagagggcgtggaaagagcagagtctgctcaggagtagagaggccagcttttgcatgcagcactgtagcgatgtcacaggaatgcagtcactggagttgcttacgtaaccaacagtctgtgtggcctgaggcatagattaagccatttaagaaaatgagtctgaaaaaataactgattgttctctgctttaatcgatttgttccatgattgcaggctacattggaaagtgagcacggaggcgccccctaatggctttgcccaataggaagcccctcacagccagggaagtttccatgctgttagttggagccactccttgccctacccagttaggatgcaggcccagaggccaccaaggagaatcagccgtccacccaccccagagggcccagggtgatgtttcagaggagagaactcaggtgccaaatgcctgtggtcccatgtgaccagatgcgtggccactgtccccagcacacccctgtgtgtccagagtggcccccacattcctttgatgcagggtccttgatgtctgtggctgcgatagagggagccagaatgatggagagcctcaggctgtgcacacataacccaacacacacctgccacacacatgccacataacatatttaccacccattccccctgcacacccacacgcaccgattctacacagcacagagagagtaagttctaactcccacccaaaatgcaaattatctcatcaaaagcaaactaaaatcaaatacaaaagcaaagaaacaaacagctgtggaaggccctactttctcctggcctggccatgcgtcctagccacactgcacccagagcagagcctttgttccgccctgtgcctcccgggctgctctgctcgtcgtgcctcttgcttgtagaagcttctggctccctggtggctcagttagacccggagtctcatgcaggacctcctttccagtccaatagccagtctggactccagggcacagaggtgaggggcacagctttgccacaagccctgagcacacttgcccatcttgttgagcttctcaccccaccctgccctggaagtcctcccctgggctcctgagtgggagccacaggttgtcctctgacccacttctctggccacatgcatgagccagttactaacttaatgcactttatgtaaaggcactgctctagcagctatttgcaagtatttttgtgaagcagctgaatatagttttctttctttttttgttatactttaagctctggggtacatgtgcagaatgtgcagaatgtgcagttgtgttacacaggtatacacgtgccatggtggtttgctgcacccatcaacccgtcatctacattaggtatttctcctaatgctatccctcccttggccccccacccctcaacaggccccgatgtgtgatgttcccctctgtgtgtccatgtgttctcattgttcaactcccacttatgagtgagaaaatgcggtgtttggttttctgttcttgtgttagtttgctgataatgatggtttccggcttcatccatgtccctgcaaaggacatgaactcatccttttgtatggctgcatagtattccatgatgtatatgtgccacattttctttatccagtctatcattggtggacatttgggctggttccaagtctttgctattgtgaatagtgccacaataaacatatgtgtccatgtgtctttatagtagaatgatttataatcctttgggtatatacccagtaatgggattgctgggtcaaatggtatttctagttatagatccttgaggaatcgccacactgtcttccacaatggttgaactaatttacactcccaccaacagtgtaaaagtattcctgtttctccacatcctctccagcatctgttgtttcctgattttttaatgatcgccattctaactggtgtgagatggtatctcattgtggttttgatttgcatttctctaatgagcagtgatgatgagctttttttcatatgtctgttggccacataaatgtcttcttttgagaagtgtctgttcatataatttgcccactttttggtggggttgtttgttttttcttgtaaatttgtataagttctttgtagattctagatattagcccattgttagatggaaagattacaaaaatgttctcccattctgtaggttgcctgttcactctaatgatagtttcttttgctgtgcagaagctgtttagtttaattagatcccatttgtcaattttggcttttgttgccattacttttggtgttttagacctgaagtctttgcccgtgcctatgtcctgaatggtattccctaggttttcttctaggatttttatggttttaggtcttacgtttaagtctttaattcatcttgagttaatttttgtgtaaggtgtaaggaaggggtccagtttcagttttctgcatatggctagccagttttcccaacactatttattaaatagggaatcctttccccattgcttgtttatgtctggtttgtcaaagatcagatggttgtagaagtgtggtgttaacttctgaggtttctgttctcttccattggtctatatatctgttttggtaccagtgccatgctgttttggttattgtagccttgtagtacagtttgaagtcaggtagcgtgatgcccccagctttgttctttttgtttaggattgtcttggctatgtgggctcttttttggttccatatgaagtttaaagtagttttttccaattctgtgaagaaagtcagtggtagcttgatagggatagcattgaatctataaattactttgggcagtatggccattttcatgatattgtttcttcctatccatgagcatggaatgtttttccatttatttgtgtcctctcttattaccttgagcagtggtttgtacttctccttgaagaggtccttcacatcccttgtaagttgtgttactagatattttattcccttagtagcaattgtgaatgggagttcactcatgatttggctattattggtgtataggaatgcttgtgatttttgcacattgattttgtatcccgagatttcgctgaagttacttatcagcttaaggagatttagggctgaaatggtggggttttctaaatatacaatcatgttatctacaaacagagacaatttgacttcctcttttcctatttgaataccctttatttctttctcttgcctgattaccctggctagaacttccaatactatgttgaataggaatggtgaagagggcatccttgtcttgtgctggttttcaaagggaatgcttccagtttttgcccattcagtatgatgttagctctgggtttgtcataaatagctcttaatattttgagatatgttccattgatacctagtttattgagagtttttaccatgaaggggtgttgaattttgtcgaaggccttttctgcatccattgagataatcatgtggtttttgtcattggttctgtttatgtgatgcattacatttcttgatttgcgtatgttgaaccagccttgcatcccagggatgaagcccacttgatcatggtggataagctttttgatgtgctgctggattcggtttgccagtattttattgaggattttttcattgatgttcatcagagatattgccctgaaattttctttttttgttgtgtctttgccaggttttggtatcaggatgatgctggcctcataaaatgagttagagaggactctctctttttctattgattggaatagtttcagaaggaatggtaccagctcctctttgtacctttggtagaattcggctgtgaatctatctgttcctggactttttttggttggtaggctattaattactgcctcaatttcagaacttgttattggtctattcagggatttgacttcttcctggcttagacttgggagggtgtatatgtccaggaatttatccgtttcttctagattttctactttatttgcataggagtgtttatagtattctctggtagtttgtatttctgtgggatcagtggtgatatcccctttatcattttccattgtgtgtatttgagtcttctctcttttcttctttattagtctggctagcggtctattttgttgatcttttcaaaaaactagctcctggattcattgattttttttaaagggttttttgtgtctctatctccttcagttctgctctgatcttagttttttcttgtcttctgctagcttttgaatttgtttgctcttacttctctagttcttttaattgtgatgttagggtgtcgattttagatctttcctgctttctcttgtgggcatttagtgctataaatttccctctacacactgcattaaatgtgtcccagagattctggtacgttgcgtctgttctcattggtttcaaaggacatctttatgtctgccttcatttcattatttacccaggagtcattcaggagcaggttgttcagtttccatgttgttgtgcagttttgggtgagtttcttaatcctgagttctaatttgattgcactgtagtatgagagactgtttgttatgatttccattgttttgcatttgctgaggagtgttttacttccaattatgtggtcagttttagaaaaagtgcgatgtggtgccgagaagaatgtatattctgtcgatttggggtggagagttctgtatgtgtctattaggtctgcttggtccggagctgagttcaagtcctgaatgtccttgttaattttctgtctcagtgatctgtctaatattggcagtgggttgttaaggtctcccactgttattgtgtgggagtctgagtctctttgtaggtctctaagaacttgctttgtgaatctgagtgctcctgtattaggtgcatatatatttaggatagttagctcttcttgttgccttgatcactttaccactatgtaatgcccttctttgtctcttttgatctttgttggtttaaagtctgttttatcagagactaggattgcaacccctgcttttttttgctttccatttgttgataaatattcctccatccctttattttgagtctgtgtgtgtctttgcatgtgagatgggtcttctgaatacagcacactgatgggtcttgactctttatccaatttgccagcctgtgtcttttaattagggcatttagcccatttacatttaaagttcatattgttatgtgtgaatttgatcctgtcattatgatgctagctggttattttgctcgttggttgctgcagtttcttcatagtgttgatggtctttacaatttggtatgtttttgcagtggctggtaccggctgttcctttccatgtttagtgcttccttcaggagctcttgtaaggcaggcctggtggtcacaaaatctctcagcatttgcctgtctgtaaaggattttatttctccttcacttatgaagcttagttgggctggatatgaaattctgggttgtgttgagtagggtttctgcagaaagatccactgttagtctgatgggcttccctttgtgggtaacctggcctttctctctggctgcccttaacagtttttcctgcatttcaaccttggtgaatctgacgattatgtatcttgggattatgtgtcttggggatgctcttctcgaggagtatctttgtggtgttctctgtatttcctgaatttgaatgttggcctgccttgctaggttggggaagttctcctagataatatcctgaagagtgttttccatcttggttccattctccccatcactttcaggtatatcagtcaaatgtagatttggtcttttcacataaccccatatttcttggaggctttgttcattccttttcattcttttttctctaatcctgtcttcttgctttatttcattaatttgatcttcaatctctgatatcctttcttccgcttgatcgactcggctattgatatttgtgtatgcttcacgaagttcttgtgctgtgtttttcaactccatcaggtcatttatgttcttctctaaaccagttattctagttagcaattcgtctaaccttttttcaaggttcttagcttccttgcattgggttagaatatgttcctttagctcagaggggtttgttattacccactttctgaagcctacctctgtcaatttgccaaactcattctctgtccagttttgttcccttgctggcgaggagttgtgatcctttggaggagaagaggcgttctggtttttggaattttcagcctttttgcgctggtttctccccatcttcatggatttatctacctttggtctttgatgttggtgacctttggatgggatctctgagtgaatgtgctattcctttctgtttgttagttttccttctgacagtcaggcccctctgctgcaggcctgctggagtttgctggaggtccactccagaccctgtttgcctgggtattaccagcagaggctgcagaatagcaaagattgctgcctgttctttcctttggaagcttcctcccagaggggcatccaccagatgccagccagagctctcctgtatgaggtgtctgttggcccctcctgggaggtgtctcccagtcaggatacacaggggtcagggacccacttgaagaggcagtctgacccttagcagaactcaaacgctgtgctgggaggtccactgctctcttcagagccgtcaggcagggatatttaagtctgctgaagctgcgcccacagccaccccttcccccaggtgctctgtcccagggagatgggagttttatctataagtccctgactggggctgctgcctttttttttagagatgccctgcccagagaggaggagtccagaggcagtctggccacggcggccttgctgagctgtgatgggctccacccagttcgaacttccctgcggctttgtttacactgtgagggtaaaaccacctactcaagcctcagcaatggcagacgcccctccccctaccaagctcaagtgccccaggtcgacctcagactgctgtgctagcagcgagaatttcaagccagtgcatcttagtttgctgggctccatgggggtgggacccactgagccagaccacttggcttcctgacttcagccccatctccaggagagtgaactgttctgtctctctggtgttccaggcaccactggggtatggaaaaaaaaacctcctgcaactagtttggtgtctgcctgaacggctgcccagttttgtgcttgaaacccagggccctggtgacataggcactggaaggaatctcctggtctgcaggttgcaaagaccatgggaaaagtgcagtatctgggccggagtgtgcatagttcctcaggctcagtccctcacggcttcccttgggtaggggagagaattccccgaccccttgtacttcctgggtgaggcgacgccctgccctgcttcggctcgccctctgtgggctgcacccactgtccaaccagtcccaatgagatgaacctgtacctcagttggaaatgcagaaatcacctgccttctgcgtcgatctcactgggaactgcacactggagttgttcttattcaaccatcttgccatcaatctgaatatagttttcaactgaaatcttagggcgtgcccacatgtcaaataggtggaacttcgctggctgactgcgagcggagagccagagcctcccctaacctaggggcaacatcaccaccacagaactcccaggctctcccggaccaggctcccttggccatcatataaacctccagggccactcagcccatctcagccctggccacaggggactggaaacacgctgctcttcctgtctgaaaactcgaaagttcccactgcttttactcacacccacagccggtcatcagaaatcctgctggctcccctcagaagcccagcagcccctctatgggggtccacagcccaggctctatgccccttgccttgcccactgcttctacttttcagacagcagccagagccaaatataaaatagaagtcattcagtttctccaaaaacaagaagggctgggcagggtggggtactgctggaagctgattggggttgtactgaatctctgaggacctaggggaggacagtcctccagaagagagctggagggcttgcaggccctgacttccagctaaagtgattgggtaatatgagcatacacagagaccgtgtatcccagaacaggatggagtccagagagaggcctgcaccaagggcaaggggaagaaaggaaagtcttttcaacaaaggtgctgaaacaactgtaaaatggtatgttaaaaaaaaaaaaaggagggccttgacgctctgcctcctaccatgcatacgaattacttcaaggcaggttaggcctaaatgtaaaaacaaaacctaaaaagcttctagaagaaggcatggagggaaaatcttcatgaacttggagttggcaaacatgttttagagaggccaaaaaagggctatggaaaggaagacaaatgatgaattgaatttcaccaaaacaaaaaattttggttcatcaaaagacacttaaaataaataggctgggtacagtggctcacacctataatcccagcactttcagaggccaaggccggcagattacttgagcttaggaattccagaccagcctgggcaacatggcaaaactctgtctctacaaaaaaaagaaaaaaaactagccaggtatgatagcatgcacctgtggtcccagctacttgggaggctgaggcaggaggattacttgagcccgggaagcagaggtttcagtgagctaagatcatgccactgcactccagcctgggtaatagagtaaaaccatgtcttaataaataaaataaaataaataggtaagccacaaactgggaaataatattcataaaacatgtatctgatagagcacttgtatctagaatgaataaattacaaccacaaattaattataaaaatacaaacaatagaaaagtgagcaaaagacttaaaaacagaaaagaagaagatacatgaattaccagtaagcacatgaggaaattttcatattagtcatcaggcaaatagaaattagaaccacaatgagatatcactgcacacccaccaaaacaaaaaaaaattaagaatgctgacaatacgaagtattagaatgatgtggaaaaatagaactttccaatgttacaaaggcaaaataataaaaccactttgggaaacagtttggtggtttcttacaaaattaaaaatacatttaagcccttaacccagcaattctactcttggatattaactaaagaaaaatgaaaacatatgtccacaaaaagacttactggaatgttcgtagcagctttacttataatcacacaaacctagaagtaacgcacatatccctcagcgagtgaataggtgaattcactgcagcgcatccgcacagtagatagtactcaatggttaaaagcagtgaactactgatgcatgctgcaacacagatgaaactagagaccttattctgagcacaccaggagagacacggaagacacttactgcatgattccatttatatggagctcaagagcacaggggccatgtagaagacaagattctacagatgtccctcaagattcctgttccctgacattcagccaaacactgctctggttaccactgcgaagggactttgcagatggaattcaggtcgctaatcaggtgactttaaaatagattatcctggattatctaggtgggcccaaggtaatatcaagggcttttagaagcaaaagaggaagacacagggccctgagagaagaggaagaagaggtcaccgagacttgaagtataaaggggactccatcagtcattgctggcttggggatggagaaaggggccacaagccaaggaacataggtggtgtctggacactgacagtgacctccagctgacagcctgcaaggaaacagggactcagtgctacagccagccacctggaacagggtcctggcacacctgaaggaggctggaagccaattctctttcaagcctccaggagggaccacggctctgctgacacctcttcagccttgtaagactcagagcagagaagccagctgagcctactggacatccagcctacaaaactgtgagatagtaaatttgcactgttttaagctactatgtgtgtgatactttgtaggaaatgatgccagagggattggctgggaggggcatggggccatctgatgtgatgaacttgatgtagccgtgatctacttgatcatgctagtggttacagtgatgtgcacacttgaagaagttcacccagctgggcacagctctgggcattcattctaccatgtacaaattatccagacataaaagagaataaaaccctgtcatttgcagcaacgtgtgtggaactggaggtaattgtgtaagtgaaacaagccaagcacagaaagatacattttaaaacttttaattaaatgaaagactgtgagaacatttctgcagctaagaatctgccaatggtctggtctcttccaaggtaaaatcttgcgtccttaccatggccccatgctgcacactccaggcacaggcttccctgtccaactcatcgatagactctacagccacacaggcccagggcacagtttgaccgtgatgttctaatgaccaagaatgctgccctccaaatagccacatcactcccttcctcatttcttcagatgtctgtcctgaagtcatcttattagggaactgtttggtgcctgagtattaaaacagcacacagtaggtgccccctgaatctctgatgaatgcttgaacatggttcctgggtggacacagtccccctgatgcatgcaggtcactgagggatgcagtctcctgggaagacaagtgctcctgggtggacagggcctcccagccctcaggctcacacagcacagtgggttctgcacctgcacccatccctgtcaccaccctcatctgcttctcctgggtacccagccttctgcaccaggcaacctgggaagagcggggcaggcactgctcacccaaattctgatccctccatgagtgggggctcattattttgtagacatagagatccagcaggatttcattgaatctgaacaagcaggaaatttcctaggacaagcagcctttttctgtcatttgtgtaggctggttggccacccacgccagctctctaactgtgctctgggcttgatgacctggccagggtgtgaggcctggaccctggtggcttgcagcagactccactgctaaccctggcatacacagacactgtgggaaggaagcgagtggacttcctggtaaaataagatggaaagagctagaaggctttctttagaagtgacaaattaagctcctcctggaagccagattggaaaacactcaagagacatgaagtgatttatttctcatgtctttgggatttagttttatttcagttttaaaaaggtgcctcgggaatttttaactgaaacgatttaactgaaaggaatggatttctttcttaagtaccgtgcagatctcagaaccagggtgcagagtgcctggtaaatcccacatgagaaggctgctgtcactctcagcaagcatactttaatttttaggactgaattcattttgacagttggcttcactgtctttgatatttttatgaaaatcagtatttcaattcctttttaagaaccattttaaggttaaaggccaggagaccttactttggtgaatgaagttaacggtgttgctgatttcagtaagtagctttttaggctgtctagaaagatgattgggctcagtgagaagattgacttgcaagttaactctggctttctgcagcatgacgttttattccaacaggttcccacctgcactgaggcaatagtagaaacactgttgcttacacatcgggggaatggcagagagtggggctgagtagaaatgaatatagccactgaattcatttatttctctttaaaatcaacttatatgttttttaaaaattcatctgacactttgaaatgaaattatatattttctaaaagtcccccccgctggactatcattttggtcctctctggtcccgccctacagcccagccccgctgacctcctgttgtatacatgagccagaggtggcctccatgtcctggcccctaggctggtggacccattcactgcagacccatttgctgaaagtctgcccgccccaaattcaagtttttacatatccagttgttttaaacataggccaattataagcagagttttcgccacggagagcctgccagctttgcatccagcatgaaacctccccagcatccactgcccactggtaagatagagccttgtgtctataaagccccgagatgctgctgccctcagagctctgaccccgagaccccacttctgagtgacatcacctgggcacgtgtctcagtctaggctctctggtgaaacagaaccaataggagatgtaggtcctgtgtgcagtcatgtgccacataatgactttgaagtcaatgatcgactgcatattccatggtggtcccataaggttacagtggagctgaaaaattcctatcaccgaatgacattgtagctgtcatgtatttgcagggatgctgcaaataaatctactgtgctgccatttgtataaaagtctagcacatacaactatgtacagtacataatacttgataacaaatgactatgtaatgggtttatgtatttactatgctatactttttatcatcattttagagtgcatgccttctatatatatatatatacatatatatatacacgtgtatatatacatatatatatatatatatatatatatatatattttttttttttttttttttttttttgagacagagccttgctctgtcacccaggctggagcgcaggggcacgatctcggctcactgcaagcgccgcctcctgggttcacgccattctcctgcctcagccttgcaagtagctgggactacaggcgctcatcaccaagcatggctaattttttgtatttttagtagagatggggtttcaccatgttagccaggatgttctcgatctcctgacctcgtgatctgcccgcctcagcctcccaaaatgctgggattacaggcgtgagccaccgcgcggccctacttatatatttttttaaagttaatgtaaaatggcctcaggcaggtccttcaggaagtgttccagaagaagacattgttataagagatggcagctccatgcatgtcactgcccctgaagacctaccagtgggacaggatgtggaggtggagacactgatacggatgatcctgaccctgtgtgggcctaggctaagaaaaaatgtttaattttttttttaaaaaaagattatagaataaggatataaagaaagaaaatatttttgtgctgttgtacatatgtttgtattttagtctaagtgttagtaacactttgtaatacaggagtcaaaaagttttaaaaatttataaaataaagtaagctaagtttaatgtattgttgagaaagaaaaaattaaattagtatagcctacttgtacagtgtttctgaagtctacagtagtgtacagtaatgtcctggccttcacattcactcacctctcactcactgactcatccagggtaactcccagtcctgtaagctccattcatggtaagtgccctgtgcaggtgtaccattttttattttttataccatatttttactgtacttttttatttttagacatgtttagatgcacaaatacttaccattatgttacagttgcctacagtattcagtacagttatatgctgtgcaggtttgtagcctaggagcagtaggctgtacacagagcctaggtgtgtagtagtctatgccatctaggtttgtgtaagtgccttggtgatgttcgttcgcacaatgatgaaatcgcctagtgatgcatttctcagtaggtatttccattgttaagtggcacatgaatgtgcagtatgcacacatatccatacatgtttgtgtgtgagtgtgcatgtacatgtatattatagagagagtgggggagagagacagacctattataaggaattgacccatgaggttatggaagctgagaagtctcacgacctgcagtcagcatgctggagaactgggagagctgggggtgtaagttccagctgagtccaaggccagctcgatgacagtcaggcagagagagtgagtttcctcttatttagccttttgttctactcagcccttccgtggattagatgaggcccatccatgttggggagggcaatgtgcgttgcccagtttacaaatcaaaattaaatgttcatctcatccagaaataccctcacagatacacctcgagtaatgtctgagcaaatgtcttgtctaggtaagctcctgctctgaggatgtgccccttccccatgtatccgctgcagaccactccaagctctcccagttaagcttgtgcatgccgctgcctgcttgtggtctcatctcttttccttgttaagccaccaaatctctcaaactcccaacacctctatgcagatggtggttttgcaagcctctgagcctttctatgttctatgccccatattgccctccctcttcctctcccgggaagcttccactcctcgctcacaaatagcaggatgtgtcagcccttgtgcagaccccctggctcctctgcaatacctctcagtcatcccagtccatgacagttgttcccatgtctgtcttacctcttactctgttagcctcttaagaagcacatacgcatctttattcatatccatgctatcagcacccaaggatgcctgcacgtacagggagcctcgtgggggtatgctcagtgaatccatggccacaagccagccagccttccctaaggcacagcatggagcacttccttttctgtagctataggctgttcagtttagctatttcttcagctgccatgaaaacgcttttaccatatatttgcatcattgtttagattaattgtattctgagtacagagaacccaagcatctggaaatacttaagaattcactttgtttataagatatggagtgtgtgaagcccaaaagtagaatttatcaggctgtaagtacatattcttttatctattcatacaacaataagataatttcgtctgtggaataagtcaacaatgaattaatgcctgctatgtatgtatgtgtgtgtgtaaggtatttccatcacgtgatgaatgatgatatatgtgtgtttaatttattattgtatatgtgtatatacacatacaccaaattacactatgcacatactatatacatacacacatatacaataataaacacacacatatatagtcattcatcactgaatgacagaaataccttatgagacatgtgattggtaatttcatcattgcacaaatattaaagttcacttccatgaagtagatggcatagcctactacatacctaggctctaggctataacctattgatcgtaagctacaaaactataggcaattgtaacacagtggtgagtatttgtatatctaaacatagaaaaggtatgtgttgcactatgaagttacaaaagctgtgatgtcactaggtaataggaatttttcagctccactatactcttgtgagaataccattgtatgtggtctgtcattgacggaattgtcatatagcacatgatggtgtgtgtatgtatgtgtgtgtataattataacttgctcttctttcactcagttgatatatatataaccaaattgaaaggtttttttcccaaaattattatccttttatcataagaatatactaattatattttacattaccatgagattgatagtttcaatactaatcttacagagtaacacaaaatagttatcattcagtactaaaactgaatgatttacttttctacattatttagccagttgtttgaaatagttgagtacacaatttagtttagcttttggatgtctgcatattcattaaaaataaccaaaaggagccagttagttacccaaacaatcacatccgccaggcatttaggtaaactgaggccctgaggatattagtataaattcattgaaaaaatgcaaacaaaatgagaaaatacaggtgggcatggtagctcacacctgtaatcccagcattttgggaggccgaggtaggcagatcccttgagcccaggagttggagactagcctaggcaacatggcaaaaccccgtctctacagaaaaaaaaaaaaaaaaaacaagcccaggacagtggacacctgtagtcccagctactcgggaggctaaggtgggaggattgcttgaacctgggaggcagaggttgcagtgagccaagatcatgtcactacacgccagcctgtgtgacagagtaagaccctgtctcaaaaaaaaaaaaaacccagaaaaacaaaatgagaaaataaaagtcactcctgatcctactctttaaagagaatcccaaggctattttgatatctcttctttcagttctccatacacatatccatatacacacgtgtgtgtagatgtaatatgcgtgtatgtatatgtatacatacacaggatttgtagcatacatctttttcaaatgtttgaggtagaagcaactagctgtttccaaaacccatctttccttctgcctaagcaggctacgaggcctcatgtcccagtctcccttgcacttcaatgtggccatgtcacccaccccacagtggaacaacagaaagtgtgccatgtgcccttctaggctggcccatcataggctgcctgaggaggtgaagtttgaggagagtctgcagtgaagccaagaggaagaggccctcctcccctctgagtagcaatccctgccctccaggctgccatagtccctggaaaagcagtctcggctgtgagggacttcccctgtccctgctggttgagtgggctgctgccgcccaggcagccttggaagccacgtgtggaagatggtacctggatccctggatgagtgtgtggagcggaaccatcagaggcctggactccaccctggactgctgtgtgcagaaaggaataggccttttgtgtttaagctcctgatgggaggcaggaggctctactgattgccacagtttaacctaccctgattcattatttctgttaaatattgaggtggtacaaaattaatttatcagaattcattatgaaaatacccagcttagaaagggtgaggggcatggaatttgtcattaactttgaaatccctttgtgtttcttgctaacccatcatgttgcctccccctgggaaacgaccactcacctgaagtttgtgtttacctttcccttgctttcccttagcgtgttgccatgcatgtctgcacctgtagtcaatatgttgcttagtattgcaagctttggccttcaaataaatggagccagactgcatgaatatttaggaactttctcctttcctacaacaagatattcctgagactcctctgtattgttgtatggaattaaattgctttttcattgccacatagcattccattgtttgaataaaccaaatgtatttgttcattctacttttgatgaacatttgacttgtttctcttttgtgctgttatgaacagggctgctgtatgcatctttagtggctctatgtgcatatggcagatgtacgggcatttctgtagggattataccaacaagtgggattgctggatgccaggacacagggtattttagataaaaaggtcagggagagcctttctgatgaggtgatagctcaggagagaccacaatgaagtgagggagaaagagtgcagatattttgagaatgcataatccaagcagaaggaacagtgagcgttagggccctatggcagaaagccctggcccaggtcagagtggctggagcccaaagagggacagcaggcgaagtcacttggtgcccggggccagattgccaagggcctggaggccatggggaagactccgaagttatttggaaagtgattgaaagtccctggggtttcaaaggagaggaacatgataagatttacattttctttttttttttttttgaaatggagtctcagtctgtttcccaggctggagtgcagtggcacaatctcagctcactgcaacctctccccctgggttcaagcaattctcctgcctcagcctcccgagtagctgggattacagacgcctgccaccacacctggctaatttttgtattttttttttagtagagacggggtttcaccatcttggccaggctggtcttgaactcctgacctcgtgatccacctgcctcagcctcccagagtgctgggattacaggcgtgagccaccgcgcccggccaagatttacattttcaaagggccactctggctgtcctgtggagaacaggtgacagggcacactggggtggaagtaaggagaggaaccagaagcctctggcaataatccaagcaagagatgcagccaacctagggtggcaatggtagagattttgattatgattagatcaagaatgcatattttaaggtgaagctgcaaggacttgctgatgtcgggtgtgagggtaagaacagagtcaagcatgatgcatggatctttggcttaggctgtgttaggcttgggatgctcttagatagccgagcagaggtgttgagtcaggagctggatgtgtgagtcaagagttagcctgaggacaaaactccaggagtcatcagtatttagatggcactcacagcgagcagccctggcgggcaatgtgggtggagaagagcagtggtcctggggctggagcccttcagcaagcagaggccaggaggaggaggaggacccagcaggggagacccagctgagcagtagtggagagggggcaagccaagggaatgtggcatcccagatgccaagaagaacatggctaagggagtggctagctctcagtgttcctggggttggcaaagtgcaggccatcagtgctagggacatgggtggtgtaaggggagtggtgggagtcggggaatgagaggaaaatgaggagagtgggccaatcgtgttgtttttaactttcagactcttcagacttacactgccccttagagatgaatctcaaccatctctccttaacattgccaaaactgggactcaaagaggaggcagaagttgcccaaagtcacaaggcaagctcacagcagggctgtggccaaaatctggcccctgacactccccgctcttctgactcccacccctgagtgaatgcctgtggtacccacagccctggggggctgctgtgcagaaaaccctaccctcagtccttctaggacttgctatctaacacaccatagccatgttgtaaattgataggtatgtgagctattcacactgtatgtatggaatttagactttcatttaaattcagggtaaattcatttaaagaaattgactataaaagctgaggctaagcctcccacccaccacatctgcgctgtctgcagagtctttatgttctgcctgcatttcccttctttggtcattctatcctggaggaaagaaaccagataaatggattcactcctagagtaataggaagggttaatagtaatcgtaactggcaggagcctttctccatagggtgaaccagcgtagcctcaccttcagaattcctgctgagggaccatcctgaccctacctgcctttcttctattttaatgtatacatttatattcacatgcatatgtcattttgcatgaatggtatcataacatatatatcatttgtttctagaaaaagtcttctttgttgcttggctcatcccaatccctccttcctctctctattgatgtcattacaactcccggaaacccatgtgagcaagctagtatgtgttcttccatatttttctccaagctcaaatagtggtctgtagacacctatgtacatatacatctttatgtatacacatatatgtatacacatatgaatacagccggggctctttctggagcacataagaatctggaggttgcaagtgagaaggattttcagaccaccacttagaggcttgcaccccagctggaagggtagaggagtgaagggcagggaagccgcagatagaaacacataactcaaaggtcaagctctcaaccctggggatgccgggtggggacgcactgtgctgtcacagcctactgccccagagcaccgaagcagctcacctgtaggtattctcctgggtgcagcatgactcacaggcagagccactgtcaccatctgggctgctgaggatgagattccccagagctgggccagaagctgtctgtttctgctcgcagctaacctcagtattcgaagacttctcctgctgccttccacgcctcgcatgaatgtttgtcatttgagaacctagagcttgtctggaaagcagttctgggaagtgccattccaggctgttcccaaattacgcagaggagaatgaagggaggggaaaggttgagcacaggctctccagcaccatccaccccttttgtcaaatcctcacccatccatatcctttggcccatatctaaccagcaagcaacagcagtaacatcgtgccctgctaattttactcttcttcattccactggaaatgtgcatgcatctcaccaacaaagggaggcgcaatgtcctccaagtcaccaaacccatcttgagttttgttcatttgccatctagctcactcacaacccatttgtgataaactataccttaaagactgaattaagagtttaatttctcctcatcaataggtcttatggcatatgacaaggaagcaagagggcacataggatttctatactccactagataaatcaccaaaccggagagaaataggcaggccatcatgatcttgaacactgcaccttgcagactccagctgacgtgtctgtgacccttttccactgcatctattgggcaccccttgtctgcagcaagcacccagactttcatatccaaagagctcagcattagttgctgctggtgacatgttcctatgtactttcttcagatttctactggcaacaatcttgcgattctttggatgtgtatggtatatcctcccaggctgtcttcgtagttaagaatctgattccaaaacaagctgggttttaaggtgacgtaggcatccccctgtaacttgtctgctcaggcaaggtcattagcaggtcttcagacaaggagaagcttctctcagtcaagtgagcagaggctgctttgttgagcccagggcgggtcagttgatgttgatgttggatttcaaggccctctggtttgtcaaaaaccacttaagtgttctcaggatcccatccagctccaaagccccagtcttgtgatcactgccatactatgttcttaggaggtctagcaaggctttcaattaaacttgtgtaattcatcagtgtgcagtgtcagaaaggtctggctctttggatcaatgcctccatggctataagagctaagaggttccttaaaggaactgggagctgtgactccacagctatacctggagctgagaattaaagcttcccttgtgttcctgttgctctctagataagtcatgaagggtcagcccaccctgctgtctttgtgctctttcttttcatcagagttgtcaatctataccagctgttgatttgcctgcactgacagagacctcatctcatctctgtgctctgttttcctggaaccatttccagtatgaaattctgtatccatcaacatttgcttaaggagacagaagctgttctaggtattccaagtaggaaggggaactagaggtttacacaaccagtgcaactgcatgaaatcagagaagcgttgctaactacgggaggttcagcagggttccctggaggtcatggacacctcatgagtcccagggagcatcacacagtccattttcacactgctgataaagacatatctgagactgggtaatttataaagaaaaagaagtttaatggactcacagttccacatggctggggaggcctcacaatcatggtggaaggcaaaagtcatgtcttacatggtggcaggcaagagagagaatgagaaccaagcagaaggggcttcccctgataaaaccaccaaatctcatgagacttattcactaccatgagaacagtatgggggaaaccacccccatgattcaattgtctcccactggctccttcctacaacgtacgggaattatgggagctacaattcaagatgagatttgggtggggacacagccaaaccatatcagcatctctgccactacccttctcagtggcctggatttacaaagcaggtgcttcacaggagcttccctggcagctgcagcaaatctcatgtctgcctctgccatgcatctgtgcaactgcatccatagaaaagtggcctggcttcatcttccaccttgcatgaatgcctcttgctagagactatcactagactgcaccagaaagagagttctgggaaaagtcctgcaagcttctctcctgcagtgctgcagggatggagaaaggcagtggtggtgcagaactgacactgaccttggacagtaaggcacaacatggaccaggcaaggacgctgttgctttattttgccaaactgggttgcattgaacacactttccagcatactgcttttctcactcaacaatccttcactgaaatccctcaaatcatatgtacatgcaacttccttctttttaatgctgattaatactccagatgtggctttcagtaattcagccagccaagtagatcatgaacacttccttttccctcccttctccctccagttggtcaccaagcactgcagattctgccctcattacctctccaaccctccacttcttcatcctcatcatccctcattgacattgctgtggtattgatatggttttgctatgttcccacccaaatctcaccttgaattgtaataattcccatgggtcaagggcagggccaggtggagataattgaatcatgagggcagttttccccatactgttcttgtggtagtgaataagtctcatgagatctgatggttatataaatgagagttcccctacacgagctctcttgcctgctgccatgtaagacttgactttgctcctcattcaccttccaccatgattgtgaggcctccccagcatgtgtaactgtgagccaattaaatctgtttcctctacaaattacccagtctctggtatgtctttattagcaggatgagaacagactaataaattggtagtggtagaatggggtggtgctgtaaagatacctgagaatgtggaagcaactttggaactgggtaacaggcagaggttagaacagtttggagggcttagaagaagacaggaaaatgtgggaaagtttggaacttcctagagacttgctgaatggctttgaccaaaatgctgataattatatggaccataaagttcaggctgaggtggtctcagatagagatgaagaacttgttgctaactggagcgaaggtgactcttgctatgttttagcagagactggtagctttttgcccgtgcactagagatttgtggaagtttgaacttgagagagatgatttagggcatctggcagacgaaatttctgagtagcaaagcattcaagaggtgacttgggtgctcttaaaagcatgttgttttgtgtattcacaaagatatggtttggaataggagcttatgttgaaaagggaagcagagcataacagtttggaaaatttgcagtctgataatgcagtagaaaagaaaaacccattatctggggggaaactcaagccagctgcagaaatttccgtaagtaatgaggcatcacattttaattgccaggacaatggggaaaatgtctccaggcatgtcagtggtcttcacagcagcctctcccatcacaggaggcctggaggcctaagaggaaaaaatggtttcatgggccaggcccagggccttgctgctttgtgcagtctcaaatcccagccatggctaaaaagggcccatgtagagctcaggccactgcttcagagggtgcaagtcccaagccttggcagcttccacatggtgttaagcctgcaggtgcacagaagtcaagaagtgaggtttgggaacctccacctagatttcagaggatgtatggaaatgcatgggtgtccatgcaaaagtttactgcaggagcagaaccctcatggagaacctctgctagtgcagtgtggaagggaaatgtgggatgggagcccctacacagagtccctactggggcactgcccagtggagctgtgagaagagggccaccatcctccagaccccaaaatgatagatccaccaacagcttgcactgtgcacctggaaaagctgtagacactcaatgccagcctgtgaaagcaactaggaggagggctgtaccctgcaaagccacagggtggagctgcccaagaccatgggaacccacctcttgcatcagcataacctggaagtggcatggagtcaaaggagatcattttggagctttaagatttgactgccctgctggattttgaacttgcatggggcctgtagccccttccttttggccaagtgtttacccattgcatgtacccccattgtatctcggaagtaaccaacttgctattgattttacaggctcgtaggtggaagggacttgccttgcctcgagactttggactgtggagttttgagttaatgctaaaatgagttaagactttgggggactgttgggaagggatgataatttttgaaatgtgaggacatgaaatttgggaggggccgggggtggaattatatggtttggctgtgtcctcacccaaatctcaccttgaattgtaataatccccatgtgtcaagggcagggtcaggtagagatagttgaatcatggggacagtttcccccatactgttctcatggtagtaaataagtctcacaagatctgatggttatataaatgtgagttctcctgcacaagctcttgcctgccaccatgtaagacatgactttactcctcattcaccttccaccatgattgtcaggcctccccagccatgtgtaactgtgagtcaattaaacctctttcctttataaattagacagcctttggtatgtctttactagcagcatgagaacagactaatacaggtgtccacctagcattcattttgcaccagtattgcgcaaatgcaaatgcagtctctgctatgcaaccagagtaatttttcttaaatgcaaatactttattttctaaattaaaaatctcatcaagtttcacccctattgaaaatgcctcagtgactcatctttgcctttgaggtcaaatctaaaccccactgtacaattcctgcagggcatctctctcctggcatctcatcctccctgccgccctgctaccatcatcctaaccagacctctcctcctgctgccctccacttcatccacacttaatgacctcagtaccttgaatgtacttgcccattctactttcaggtttatccagacgcaactttctgtccagtaacacccctctccctgctcaccctgctggattctttgccaagacaacttttactcttctttttgatctcagactaaaatgacacttctcccagggagccccttggatcccaaattatagtggttctttcctagatatcctggtggaatctgtacttctacatagcacatagttttcactgccattgtttgttctctgtatttttccctacattatttaggaatgcgttgggctccaagtaatggaaaacacaaaacagtggattgtgtggtacagatatgcacacgtgcactcgcacacataatatatatagtgtgtatgagtgcacatatatactatctagagagagtatatatgtattgaaactgtggattaggggagctattgtatgtgtgtgcatgtgtatacatgtgcatatatacatatatacatacacacatgcacatacatacaatagccccccttatccacggtttcacttttaaaggtttcagttttacctgtggtcaatcacgatctgaaaatactaaatggaaaattccagaaatcataagttttaaatcatgcaccattctgagtagcatgatgaaatctcactctgatgtgaatcatccctttgtccagtgggtccaggctgaacatgtcacccacccgttcatcactaagtggccatctcggttatcagatcagctattctggcatcacagtgcctgtgttcaagtaacccttcttttacttaatagtggccccaaagtacaagaacagtgatactggcaatttggataagacaaagagaagccatagtgtgcttcctttaagtgaaaaggtgaaagttcctgacttaaagaaaaagatattttttattacagtatttgttacaatatactgcacctgcactgtgggcctgctgctttttctgcccaatccccttacaaacttcctgcctcatgttttttcctcagatttttccaggacctgaccttcttcagatacaaacctcttgtatgtgatatgagttgcaaacattttcccaaatcgacaactgtcttttaacattttgtgcatatttgattctctttggggctttttcattgttaacgaaaagagtcaaactctgaaatatttggagagacatttggagccaaatatgagtgaccatggcccatgacacaggtctcggagatcctaataacatgtgcccaaggtggttggggcacagcttggttttacacattttagggagacatgagacatcagtcaaatacatttaagatgtacactggggccaggcacagtggcccatggctgtaatcccagtgctttgggaggccaaggcagcagatcacctgaggtcaggagtttgagaccagcctgaccaacatggggaaaccccacctctactaaaaatacaaaaagtagctgggcgtagtggcaggcgcctgtagtcccagctacttgggaggctgaagcaggagaattgcttgaacctgggaggcagagattgcagtgagctgaaattgcaccacggcactccagcctgggtgacaaagtgagactctgtctcaaaaaaaaaaaaaggacattggtttggtctggaaatgtgaaacagtgcaaagtgggggcttccagattataggtagatttaaaatttttctaattggcagttggttgaaagagttattaatagaaaggaatgtctggtttgtgataaagaggttgttgagaccaaagttttattatgcagatgaagccttcaggtagcaggcttcagagagaatagattttaaatgtttcttatcagacttaagtccaattagatgttaaatgctggatgttaaatgtggatgttaaatgctggtcagcttttaaatgctggatattaaatgtggatatttaaatgttaaatgctggatgttaaatgctggtcagcttttcctgcattccaaaaaagaggagggcataatgaggcctgtctgactcctacttcccaccttggcctgaaccagtctttcaggttaaattttagggtaccctggccaaggagggagcctatttagatggttgtcggggggccttcaaattttatttttggtttacactattatgttccattgttgagtctgatcagagactagtcattgaggcagtagagttcatgccagtgtctcagagtgctccttccttctctttgtacttacttttcagagtttctctggttattcttgcttattttttgatgtgaatttaaaatcagcttgtccgattccaaggaaggaaaacaaaacctgcttctgtgttgtttttttttttttttactggaatcaaatcaaatgtataagttagaggaataaattacaacattaagtctcctaaactaggaacatagtattgttgatggaaaaaccaaattctgtaaaatatatatatattttttgagacggagtcttgctctgtcgcccttctgagccagtacgaatgaccatgacccagggaacagtcttaagagatcctgagaacaagcgcccaaggtgatcaggttacagttttgttttatacattttagggagacagaagttacaagcaaagacatggatcaatacatgtaaggtatacattggttcagcttaaaaaggtgggacgtctcaaagatgcttagaaaggcaaggagtggggatggtcacaggtcataggtggattcagagagattttctaattggcaatttgttgaaagagttcagctttgcctaaagatttgaagtcagtagaaagaaatgcttgagttaagataaggggattgtggaagccgaggctcttgttttgtagaggaagtctccagctagcagccttcagagagaatacatcgcaaatgtttcagaccttacaacgtgtcagactcttagttaatctttcctgaatccaggaaagtgctagctgcgttaatggagagtctctacagatgcaaatttcccccacaaagatagctttgcagagccatttaaaaatatttcaaagaaatatattttggagtaaaatatatttgatttcctttagagtctgctatctgtcatgtgatgcttaccagagtcaggttggaatttggtatctcattgctacacagtctgtttggtgatctctattttatgatctctattttaatgttaatgctggtctgttgtgtctaaactccaaaagaaaggcggtattacaaggtgtgtctgacctcccttccagccatgtccaggaattcagtttttcaggcatctctgaggtcctcttggcccagagagggttcatttggttagttggtggggattaggattttattttcagtttacgatatacacagtttaacttttatgcccttcaggaatattctaagttttccacatttatgttgttgttgacaaaaagattcaagctctgtaagacatttgaagatatttattctgagccaaatatgagtgaccaatggtccatgacatagccctcaggagatcctgagtgcatgtacccaaggtggtcagggcacagtggggttttatacactttagggagacatgagacatcaatcaatatgtgtaagacgtacatttgttttgtctgggaaggtgggacaacttgacctgggggcttccaggtcataggtagataagagataaaagtttgcattcttttatgtctttgatcagcctttcactgaatacacaatttacatgtgagaggcaggtagaggaataatcacttatgccttagtctgactcagtaaatctgaatttttacataaacaatagggcagaggaagcaaccagatatgcatttgtctcaggtgagcagagagatgacttagagttctgtctgtcctttgtcccacacctgtgggataagctatcaatttacattgccagggtaaaatgccacagaactgttttagggctctgagtccctaaagaaagatcttgaggcccataaggaatttcctggtgagcaaattgtgagggaggtatgtagtgttttttatctttttagctatcttatttaggaataaaatgggaggcaggtttgcctgacaccctttggcttagtgattttggggtcttgagatttatttttctttcacattgtgtacatttcttttaaatatatccctcagtactttatcattttagttgcaattgtgtatggaatattcttccattatgtcttctaacatgtttttcttcacagattaaggctatttatttatgtgtgttcatttcacatcccgtgtattcagcactaatgcccttcacggactatgtccagctctctgcctcccgcttgtgggcacatgggaggatgtagttcctgggccccgtgtttggagggagcctgtggctagttcttgccatggattgtaacagaggtgagatatcacctctggaccagagtatttgatttttgatgggagatgctcctggctttttatccttcttccacagtcataggcttatagtggctgctctataagcctgaatcctggaatgacaagctatgtcacagagttcagtcaacccatggtggatgtgtggaacaagcaaaaagtaaacctgtgttgttatgacctctaggatttggaggctgtttgttaccatgttatagtcactcctgctgtttatggtacgctctaggtaattgtggtgtcagtgtagtgtgtttcatggtagtttccactttataaagtttctgccttttaatttcctatgcagatattcatacctcttatatcttctgttttcatatgtactttggatttgttttaatcaggtatgcagatatggaaattattgttataaaggaagaagtttgttactcacaattccctggaagcagggtgtacaacataccacacagggctacatggggaagccctgtttctgtatttctgttttaggttggctacttgacttatttttcatttttatcattcctactgtgctatctgtagtctgttttctcttttctcccttataatttaacttcatttctaaaacagtttgactccttttcccccctgagtttaatcagtttctgtttcacagtcaggaggcagagtgagtaggaggaaaaccagagcaagagcctttgttgcagtttccatgggaaggattgggcagggcacggcaagcaggctaagctggttgagggttggctagtctgagtaattccagcaggcccaaagtggaggggctgtcctgagttatctggtacctggccctgggctgattagaggaggggaatattggcctgcagtgtaggaaaggctgtggttgaggggtctgggctttggattaatgggtttatatatgaaaggcaggcttgcagaaaagtagtttgtcatctctaggaatttgctagcccaaggagatgcagcttctcccaggtcacaaaggccccaagatgtcaaagcgtcataaaatacaaagaataaaaaacatgattaatatacttcattgccaattgaacagttttgccttataaagtggttttcctcatattacttaatgctttttggcctgaattctaccttgtttgatacaagatcataatctcagttttgttgttactgttgttttgtctttgtcttgtgtacctgataaactattatctatctgttttagttgtgacctttataaatcactttgctctaggtgtgtctcttatatacagcaaatgattcatctttctttttagagataatgtaaaaatccttttctttaaatagttgcattaagcctacttaaatttattgctctcacagatacggttggttttagttctgtcatagtttctatttttctgtgtaaatattttaaatgtctttcactatgttatcttagctttttattttagaatattttttctgatattttaaaaaactatgttaatggttacttttttaaccactagtataacaatacaattatgtttataactagtggttatataagtttgcctttatgtaatatcctatatccctttttctttagacaatatcagtttattccctatatgcctcaataaaacaagcttctatcttcttccttcattctcccctctctcttctaccatctaatttaaccaatagtatatcttttgtctgttcttattgtttgcccttctactattaaatatgcttacatatacatatttgacctgtcaactgtagttttgttttttttgttgttgttatgtttgagacggagtcttgctctgtcgcccaggctggcatgcagtggtgcaatctcagctcactgcaacctccacctcccaggttcaagcaatgcttgtacctcagccttctgagcagctgggactacaggcgtgtcccaccatgtccaggtaatttttgtatttttggtagagacagggtttcgccatgttggccaggctagtctcaaactcctgacctcaagtgatctgcctactttggcctcccaaagtactgggattacaggtgtgaaacactgcacctggcctgatctgtcaactgtaaacattatctttgcagtctcatgtataacagctgaggcattgcaaatttattctgctttctaaattctaccatttttgttgattgtgtcattttcattttgacagaatattgatattcttcttcatcacttgtatctctacctttgcttttccttagatgtgcagttaaataaacttactgctgcctgactgctcctttgccagactcttattcatctcttgattggctggagttcatcctctattaattttctcaaaaagtgtccatttgagaaatgttttctgaacgattcatgtttaaaatggtttgtctacagcctttatacagaaaagagtagactggatgggcataaagctttcttagctcatattgctttctttccttcagtatcttgtagatgtggccctattgtcttttggcattgactgttgctgccaagaagtatgttgctaacctgattttctttcttttttgcttacatatttaaaaaattctctttatctttaaaagaggataattttaaaatatgttggtattggctatactagaacagtttccttatatacagtgtgccctttaaatgtgtaaaatcaaatatttcaaaaagtttgcttttttaattaaagtctttaaattctttttttttcctttccattatttcaggttttttatttggggctcaaattatgagtatgttggatttttttacctatactcggtatctaacatttttctttaaccctgtgtttctttatttctgttttgtctactttacttttcatttttatcattcttactatgctatctgcagtctgttttctcttttctcccttataatttaacttcattcctaaaacagtttgactcctttttcccctgagtttagtcagtttctgtttcacctcctcctgtgagttcatgtatatctgatttatagtttttcttcagagctgtgatacttttgtactaaattaaagcagctcatccctctctgagtgccaaaatacatatgttaagtttaacttgaaatccactgcctcttaagacaatgaaaaaaaatcaaatgatttaggagtttaaggcataaacattttcagcagtaaactgtactagaggttgtagttcttaccatgaaatctgtgtctactagtaatccaataacttgctttttggtgataatcagaaattgaggcatcctggaagaaaaacttcacaggaagcttcctcagtctttgaattattttggttaaggtcttcttccatacagctatactgtcttgctgcttggaggaactattcctggaagaagaaacagagtaagcaaatacagaaagataggacaacaggaatacagtttgaagatctgcaggagaaaatgaatattttcagctgtgtgtattgctatccaaaataaattagaattctgaacatatagaattagataaggagactagaaattggatagtcagctaatatctcccatagtcaaatatttggctttaaaacttaggatgtaagttgtaactagaattaagcttattctcatagagatggaattaatcttcaaaggagggtataaattaagagaaaagaagagcaagaagaaaaattaggggaatccatgtgttttaagggcaggaagaggcaaaggaaacagtgaagggaccatagagtgtcccagggtgcagaagaggaagtgtgaaaatatccatgttagaattaggcttctactgccctcccatggactttatggcctcagtgtgtttgggagatggcattagtaacagttgaatgagaaactcacggagtatagataagtccgtgtatttgaatctcagctccgttgcttactagctggcttttaactctgagtgctggaagttaaacataaaacagaaacctataattaatgagaataatggtaactaccatgtattagtgctttccataaaggaagaactttacaaacactatctccttttctcatttaaccctcataagaattctcattagatggattgtgttatcctaattgtacaggaaggaatgcaaggccttgggtgatgaaatgatatattcaccatcagagaattagttagaaggtggaaccagggctcaaaaccaggccctagaacctgtgttcttgactgttcttctgggttgcattccttcatcagggacatgtagcctgtggctgccccagtcttccagcctcaggtttcaccatgggcctctgcgcctttccttctcatccttacttgatgtgacatctgttggggttcccagtaacttaaaatggaaaagatgagaagagagcttatttttatttgctccttaaaattaaggctaagtttttaattctttgatttctttttaaaattttttaatttttaattgttatggatacataatagttgtatgtattgatatatacatacatcaatatgtatattgatggggcagatgtgatattttgataccagcctacaatgtataatgatcaaatctggctaattgggatatccatcacctcaaacatgcatcatttcttttgtgttgggaacattccaaatctacatttctagttattttgaaatatacattaagttattgttaactatagttgcccaatcgtgctataggatgatgcctaactgaatcgggtgtagtgtgtgatactccttcctgccgttacaagcccactgactctcagagtcgggaatcagagtgcccacgctgcctccaactccccagtgtagctgtgcctagtgctgcgaagtgccagtccagcaccccgtgtcggggtgggagccctgctgagtgcgtacccacgctgggcacacctgcccagcctggcatcacacctggtgcagggcctgagctcagaagcctatctcccaccaaagctcactaacaagagaatccctcccaagcttctgcttcgctcatattaagcttaaaataaaaagtaaaactctgagcaaaagcccaaagaaactttgagaattatttcaattcatttttctttaattgatgctttgttcccctcagagagtaagctctacaacttgattttcaaagggggatgtgatgatcagggatgcagtgtttagatgtgtgtgtgtgtgtgtgtgtgtgtgtgtgtgtgtgtgtgtgtgtatgaacctaaaggctctgagactgtatatagtcacatattttagatggacgtcacttatgggtgtgaaattctgcttttagagtcatgcagagggccatttttcccctttgaaaaacaagaactactggtaaaaattcattagtttatgtcctaatgggaaacccttcttgtcacagttcttctctatgatgagaccgttattcatgcgttcgtattgtcacctcttgtcatttcttgtccacaggcaaaaactgggacctgacagccgctctgagcgactatgagcagctccgccaggtgcacacagccaatctgccacatgtgttcaatgaagggcggggtcccaagcagccagagcgagagccacagcccgggcacaaggtggagcgaccctgcctgcagaggcaggacgacattgcccaaggtaccgctgagggactgagcctaggcacagccgcccaggccagtgcaccgcagcttgcaggcgggttgcgtggtacaaagaatggtggggtcatcacctcccggatgcagacatattggcctctcagtgccttctttctcacactatgccgaaatgtcctttgttgcttctatccatggttccaacctctacctcagaaaagcagaaaaatgagtctgatttcctaggaccccaaaagcccaataagtgagtaaaagccagcattcctcctggagtcttggttttttcagaccaaacatctctagttctttcacatatttccaaagtaacacagtctccaagtctgttcagcatcacatttcttgtcccatgcgctccatcttctctatcctttttcttcattatgaaagtaagatatgcttattataacaaaggaaacaatacagagatatatgaggaaaacttaagagcattcgcctccacacctcccagatctcaccagtgtaatgacggctgataacattctggtggtctcctcctgctcctcttgctatattgttcaaaatcaaacacatcagagtcaaatgcacagcacactgcaaagtgcttgtttcactgagcaggagatgatgaacataatctctcaatagctacattttattctataatgtgttaatttttagatcactgctgtattcatggtgattctgtttttgcttgggtttttgtcgttgttattatttgttaattgccactgaaagcaatgctgaaagaaacatctttatacctctaatcttacatactggtgcttttgtttctatgggtttgcattcccagaatggatttgctgtgccaacacatgtgtgtttctagcttaataattttagggcttctttcctaatatattgctactcaccatgtgtgaaaccgggtgtttcccttcaatcttgccagcactggaaattacaatgtatggtgtgctgggccattctttcactgctgtaaagaaatacctaaggttgggtaatttattttaaaaagaggatttcttggctcgtggttctgcaggctttacaggaagtatggtgctggcatctgctcagcttctggggaggcctcaggaagcttacaatcatgcagaaggcaaagggggaacaggcacttcacatggccagggtaggagcaggagagagtgagttggaaggcagaggtgctgcatacttttaaatgatcagatctcatgtgaactcagaatgagagctcacttatcaccaaggggttggcccgagccattcatgagggatctgcccccgtgatccaaacacctcccactaggccttacctccaagatggcggattgcatttcaatatgagatttgggtggtgacaaatatccaaactatatcaatccactcctgggccctcccaaatctcatgtccttctcattgcaaaatacaatcatgccttcccaacagtccctcaaagtcttgacttgttccagcattaactcaaaagtccaaactcttgtctgagtcaaggcaagtcccttccacctgtgagcctgtaaaatcaaaaacaagttattcactcccaagatacaatcgggtaaacattcccattccaaaagggagacattggccaaaagaaaggggctccaggcctcacacaagttcaaaacccagcaggacaatcattaaaccttaaagttccaaaataatctcctttgactccatgtctcacatccagggcacaccagtgcaagaggtggactcccaagaccttgggcagctctgcccctgtggctttccagagttcagcccccatggctgctctctgctttcagcttttccaggtgcagggtgcaagccactggtagatctaccattctggagtctggaaggtggtggcccccttctcacggctttactaggcagtgcccccatgaggactctgtgtggggcctccaacctcacatttccccttggcactgccctagtagacgttgtgtgtgagggctatgcccctgctgcaggcttctgcctggacacccaggcttttccatacatcctctgaaatctaggcagaggttgccaaacctcattcactcttgcattctacatgtctacaggtttaacaccatgtgaaagtcaccaaggcttatggcttgcaccctctgaagcagcagcctgaactgtatctgggaccttttgagccaaggctggagctggagcagccaggatgtggggagcagtgtcccaaggctacacaaggtagcggggccctgggcctggcccatgaaaccattctttccaactaggcctgtaggcctttgatgggaggggctgctgtgaaggtctctgaaatgccttcaaggctttttctccattgtcttaggtaatagcactcatttagcttccttttcgtcatgcaaatatctctagcaagtagttgctcctcaggctgcttgaattcttctgaaaaagctttttctttctttgccacatggctaggctgcaaatttttcaaacttttacattctgcttcccttttacattctgcttcccttaaatataagttccaactcctatctttgctgcagcatctgaatgcagactgttagaagcagccatgccacctcttgaatactttgctgcttataaatttcttctaccacataccctaaatcatcaagttcagacttccacagatccctagggtatgaacagaatgcagctgagctctttgctaaggcaaaacacgtgaccatttgctccagtccccaataatttcttcatatccatctaagacctcctcagccttgactctgttgtccatttcattatccgtattttggtcataaccatttaaccagtccctaagaagttccaaactttccctcacttgctgtcttcttctgaatcctccagacttccaacttctgcccattacccagttccaaagttgctttcacattttcaggtacccccttggtactgattttctgtgttagccctttcttgcattgctatgaagaaatatctgaggctgggtaatttataaagaaaagaggtttacttggctcatggttctgcaggctttataggaagcatggtgccggcatctgctcagcttctggggaggcctcaggaagcttaaaatcatggcaggcctcaggaagcttaaaatcccaaagagggaacaggcactttacatggccagagctggagcaagagagagagagtggtgggtgggaggtgccacacacttttaaatgaccagattgcgtgtgaactgagcaagagctcacttatcaccaaggggatagtccaagacattcatgagggatctgcttctaatccacacacctcccaccagaccccccctccaagattggggatcacatttcaacttgagatttggagacaaatattcaaactacatcaaatgtgtttatgttgtttttctactctgaagagtggaaaatggtgtcttgtctcatcttgtcatttgcttcttaggccattggatttcccctttgtaacgtggctgttcgcatactttgtccatttttctattgattggtttgtcttttcttatcaatttgttgctctctttgtaataaagactaaaacatatatttcctctatatgtatatgtgtttttcccacatatcacttgccttatgactttcttttcagaatattttcccatacacaatgtttacattatcttgttctcatggctgatgagctttctctctcactttggaaggtttcttggactacagaattactgaaatatattcttttttttttttttttcttttgagatggagtctcactctgtcgcccaggctggagtgcagtggcgcaatctcggctcactgcaagctctgcctcatgggttcacaccattctcctgcttcagcctcccgagtaactgggacacaggcacccgccaccacgcctagctaattttttgtatttttagtagagacaaggtttcaccgtgttagccaggatggtctcgatctcctgaccttgtgatccacctacctcggcctcccaaagtgctgggattacaggcgtgagccaccgtgcccggcctgaaatatattcttatatttaatttaaattttgttctttgagtcttttcatcaatttgaaatttttgtaaatagcaaagaatctggttttgctttctcctggattgagagagagttattcaagtacattttcccactgaactaaatgccagctttgccttatattaaattctcaacatacctggacctatttccataccttgttctgcccacccctgtggctgcccccctgttacacttgactcagtggtttcacagggtctcaccctcaccttctattgctatgcttttcctttttttgtgtgtgctgtttttgaatatttattttgccatctaaaccttaaaattataattctgagtggaattggaatggatttttatttaattttaaaaataatttgcatttataatattgttcttctatccaagaacattatgtatgcctctccacatattcagattctgttcagattttaagcatggaaaaaagaaactcattttttacttatttatcttttatccagtgaactacataaattctcttattagtcatttgcttaatgactaagagaatcacttggatatctaagtatacaatagtatcatctgaaataattgtaagttcttcttcatatttatacaattaattcagttttttattttattgaattaggtagactctcctgaactgttgcaaatgaatgctgtctttgtttctattagctcagcctattattcaagctatattgaatctatatcttggattattctcaactgtttattctgttgtttagaaaagccataattgagttagaaattttaatacatattatctgtgtcttctctgagtttcatcctttctgctgtatttgttttgatgctatcttgttaggtatatgtatattcataattttttagattatcttcctcgtgtgttttttgaccaatatataggctgtctctttgtcaagccatttgatataatggtttttatcttgaaatctgcttttgttgatattaaacagctaccctggctttctgttggttcatatttgccagaaatatcattttttctgctgatataatttcaacttttccatatcctttcatgttaaatgtgattcttgtagacaatttattattaggtttcattttattatccaatccaagaatctctgtcttttgagtggttaattcaatccattcttctgtcctatcttctctatctagttaaatttttctactggtttgcaagttacacattctacttttactcacattgcaattactgctattctattaaaatcattattttggttttcttcctattatttttaaaaacttaacaactatattttcccctgcaaaatacatgtattaatatgattttatgttgttctgtcctgcctctacttgctctcaatcttatttagatactttttgttgcctttgcttatttagataacaattaactcctttatttattcacatgtattcttttctcttttgctaaaaaaaaaaaaaccttcctcaaagactacttccaaaaacagtttttgcatggtgaatctcctaaggccttgagtgcctaaaaagatttacatggtatacttaaattttcatttagtagattaaaaactctagattgaaattattttctttgaacaccttccaacccttcctccatcatgttcttgcaccttgttctcatgtcttctaagagattcacttgacctgatgttttcacatccctatttattctgcacatgaatgcattattagtcccattaacattttttttaatcccaagttaattctttgtctttattattgttattattattttgcattctgatattctatttatctctttgcatgtatttactaggctcattttttaatctagtcctcctggccagtactttgttgcctttctttaacagtttccctgaagctcctggggcacgcagttatcatccatcttcactgtgctggagcacaggctctggtggatgctcctccagatgagagtcggggaagggtactcaagctggagagccttagatgttgtcatttgggctctagaagttccctgcctgttcccctctgcatagctggattgtctactgagggctgctcccagctcctctcttctagaaagtccttgtttcctgtagggactgccctgctctggtgtaaccgccaagctccccagtgtgttagggaaaggagggaagcagtgcttatggtgactggtgccccacccagctgtgctccagcaccacctgacattctccagctggcacagggctggggctaggggatgatagggaaggcaggccatgctggagccatgctggggagaggaaaggcaggaccaagacgccctaccccaggccctctctgtcggcctcacccattcccacctcctgcccctgaggatttctaggtgtgtgtgaggacaggacactgaggctatgcactgtcttgcccctcttgctgattattcttaaattcggtttcatttctgccattagacctgactccagaggaaccaccccttccagtccttggctcggtcttgtgctcagggccttccttgactacaccacacggttaaggctgctggtatctttcaggcagcagcaatccagacagatggccacatggcagtcctgctcttttgagctggcagcaaacaaaccaacccattatcttatcctcctggtacaggggctagaaggacccttctctctgctaccagagagattggcagaatcagggcctagtaagtgtagctgttacatactgtgatctgacttttcttagatatcatttaagaaaaaaaaaataggactctatcccagcataatcctattaattgagccttgcgagcaatcatatcgattcctattgaattacagagtttctgaattaaatttatgtctcctttagttgagttcttcctgaaaccatagtgtgccaaaatggaaaatggaacatttcatattctaaatcagggcccagaaaaagacctgtgagcccaatctgggctgttttttaagtaaagttttattggaacacccccacgctcactcatgtatgtactgtcttcgacggctttagtgctgcaaagacagaggtgagtagttgagactgcatggcccacaaagcctaaaatatttctgtctcaccctttaggaaaagttttgtccacctgttttaaaatatacccaggatcggttttaatcaggtgtcataagacacgcagacacagaaatgactgtcatgaaggtggaagttgttttttttttttaactcacagttccttggaaacaggaggcccagcacagcatgcagggccacacggggaggcgccggtcatctggagataggagtgaggggaagcatgggccaaagcctttgaggtggtttctatgggaaggcagggcagggggagcagccccctaccccagctagtgtgcataacggcagccagctcagaggcaccaggtaccaggtaccagggcctgtctccggctgcctggtccctggcctgaagtgcttagggcaaaggaacgttgcctcctggagagtaagagccagctggagagggtagtcaggagtgtagattctggattggctgctccgcataggagaggtgtgctgcggggcaaggcctttgccatctcttaacattggctcacctgggaggggcagcctctccccagtcagggaggtcccaggtgccagagccacaaaaacaaagaaaataagaaaacgcagggccagatgcagtgactcattcctgtaatcctcgctgagcccaagtgttcaagaccagacagggcaacatggcaagaccccatctctgtaaaaattaaaaataaaaggaaaataaatgaaaaaagaatatatagttaatacatctcccctttgtcagtggcagggaaattctgtacattcttgtactatgttttgttttgttttctaatctttctgtatttttctgagacataactttgatcatggtaattcctgtaaaacattttatttatacatccaaaagtagaatcactgagttcacgtttaaagaatcagtgtgtgaatgtgtgtgtgtgtgtgtgactctgtgtgtgtgtgagagagatgatatgtgtgcattcctggggtgtcacaggaaatgttagaattaggagcatatatttctcattttatatgatcttcaacgcaatctattaatatttttagttcaaaaatacttttttccctcaaactccaaatatttcatgtttagaactgcagaaccacatcatgttgtcctaggaatcaccgtgtttccaaggccatcgaagtgtctcatgtgggtgctgattgatgggcccgggaggagcatgggtgcccctggacaacaggtgcccactgttgagagcagccttgagattgtctgtcccaccgattgcaggtgcacatagcacctcgattctctaatgcctgatgtccctctccatcagattccgaaaaatggggcagttccttctttcccagatacaaaaatggtagtttgtggcaagatgagtggcctcagcatggcttgcacgaggcagaaagacacaagcctccactgctcctgcactcaaggacctgaaccagcgtgggaagcaatgggccgtcccccaccacccaagctgggcccatgtgctccctccctcttctttctaatgtcctgtgtggtttaacttctctttttacctttctgcaaaatacaaagaacttaatcctgttggtctctgaatgaaattgaaggtgaatctaaaccacccattgcgaaatgtagtctgtctctgtgactctgtattcattttaatgggaaaaatacatgaaccttctggaaattagcttcggatttaaaactaacttgccataggatcaaaagcttatgctttttagtctgttgtaacaaaactccatgaatgccatttctgtccagtgctcttgcaagtggggaaggaaaatgctgctgttccgggtgaaagctggggctgggttttccgtgtgaccgtggtgtgctggtcagtgtggacctcagaggggcattgcaggagcacagacctcaccagtgggcaggctgaactggaggacagtgggattccttgggacctcagggaatagcctcaggaatttgccacagggcttagacaatgcttatttatacttaatttaggcaacacaggcagcaggcttttgaataaaacaccagagaccatgctttcctgagaaaaatgaaagatctactgccctgctaaaaagacttctccttactgaaaacactatgagaaaagataacctattcttaacatatatttaagcattcttgttttatgttcaatgttagtcattagaacacagggcttataaaaacaagcgtgcttttgcagcatcaagaagatacatctactttctaggtaatcgacttcctaacatggtaacatattgtaccttagagaaatcctacactgcgtttctcattccctggctgaaaagcccaagaagaataaagccagaggagagcattatttttgagagtgctgtggcaaaagaatatccagacagaagagaaacacatggactgacttaatattgtgtgtcctgggagggccatgtaggaggcatttatcagcgtaactttagtaaaacaacctgtcttaaaacctgagctgctgtggatgcctgaatgattgtttctttgcattaagtgcataaatgcatcgagacaaagagcggtctcccttgtaccatttagtcctgggagaggacaactcagtggaattgaggtagatgtaacttcagacccaagagcaagcctggtgctctttgacagtgctgatgtgcagttgtactgtgggcttgcagctccccacttactaagtggtttcatgactcttgtgaataagtgccacataccaggtggtggtgattaatccagcagcaggaaggcctgcaggatagaaaaggcttgtaggatataagggctgttgcagagagaatatgggtgtgcatgtgtatgtgtgtgcacacatgtatgtgtacgtgtgtatgcatatagtctgtgcatgtatgtacatgtatgtgcgctgtgtgtcctgtgtatttgtgtgtgcaaatacatctatatgtgtacacgtatatagtatgtgtatagtctgtagtgtatgtgcgtgggcatgtatatatgtgtgtagtatatgtgccaactgtttctatgtgtgtgtctgcatgcatgtatgtgtatgctatgtagtgtgtgcacatgtatgtatacaagtggatgtgcagtgtatatgtgtctagtgtgtgcatgcatatgatcctgtgtatgctttcgtattcatgtgtgagcatttatgtgtgtgcatgtgtgtgtatgcgtatgtgtgcagtatgtgtatgcacatgtatatctctgcttataagtgtgtgtgcacatgtatatgtatgtgcgcatgtgccatgtagtatatatgtgtgaacatgtatggtgtgttcatatgtgtgcacatatgtatttttgtgtgttgtgtggtatgtgcatgtgtgtggtctgtgtgcatgaatgtgtacctgtgtgtgtgtattgtgtgtgcatagtatgtgtgtttatgtacatagagccacacctacacccactcagcccttggggctatctttccttctccccctgcagaaaagcggctttcccgggggatttcccacgccagctcagccatcgtctccctggcccggtcccacgtggcaagtgaatgcaacaacgagcagttccccctggagatgccaatctacacattccagttgccagacctgagcgtgtacagcgaggatttcaggagcttcatcgagcgggacttgatcgagcaggcaacaatggtggctttggagcaggcaggtgagttgcccctgccagcaggcccaccctctttaggcttggtgaatggtgagctggcctaacctactctatgagcaagagaagggcacatgttctcagactctgggcagttttcagttaggattctagatgctgcaccgcacctcctgctctacgggccgacagtgttctagccagcatgggctggatggaggggccgataactaggtggtgctgaaatctctcgagttttccccttgctcctaaatcccagtcctcctttaaggagaactctatgcttctttgccttgcttctctctttccccagacaactcctccgtgggtgttgaatgaaagataggaaagaccatgggctttagagaaaacgggagacccgccacttcctgtggacttgggcaagtcaggtgatctctctcagcctcagtttctccatctgcaaagatgaggagactgctgacccggcaacgctttggggtactaagtgacatgtgctttccatagctgtccattccctgcctgcgcagcctcttccagcttccaggttaaggaagcacaaaacctgacctcagtctccttccttctccttagtgtttcctcaccaccctaacatcccaatgaagaaagcgttcaagaagcaagacaaactctcttctttggaatgtttaaggagaaaataatgagtccaaaacaaatgtctaaaacagatttaggttcttcctgagacaaagcaatgccagtttcactcataatcattcacattataaacattgcaaaatcacatatctgggggtttctcaggcacgcatgtggaagatgttatggctgtctcctcaggcccaccacgcccctcccagtgggagccccgcctgcctgcacgggctgacagtgcacatggagcatgtcctcagccagtgggaagccctgctcctgctggggtggggaagcatcgccttccagtgctgacccagccttcagccagctcttcatgtccactgtggagtggagcctccacttccaaggcttggtccgtggagacgtccccagatgtgtcatcccaggagtttagggctgcagccagcaatgcactgttagggagtagagcttttctcggtgctcggcgaagacccaataaaattaccaagcactttctagagttccagaagaagacaggagagaagtacctgtaggttggtatgattctgatattggtggatggaccaatcaggaccctggtaggaaagaaaaggcagcacaaaactgtgagataaaggactccataaagggactgctttccaaggagtgggcaggatttaaggacactagtgaaggatactaccgttcctgggactaccctcaggcctggcaaaaagacaagggatgagagtggctgatggagatagccacgggcagtaggtgtggcatccgggagagagaagatgctggggaaataaatactctgaccacactcttcctccaccatccaggttctgaccagtgcctcttaatggcagaagggcagattgcggggagctcactgatgtggtccacgcaggtcaccctctgcatacagagcagcatggagaaggatagacggtagatctgtggggccaatgggaaacatccagaaagtcaatgtgccgggaagttttaccagacctggcttctgtgtacacgtgtacacctgctttcatgccattgcttgtcattgtttgcccagggctgtcgtcatccaccactttcaagagggaaggcacaagatgcgtttagacaaaggacgagatgtgcctagtggggcttatttgtgttgggcaggcttgcagtcaggtcgtagccacaggactcatagaagcctcaccaatggcatgcttgacattagaacaggctctacattcccaacagctggatctcatgttgtgactgtggagaaattctcatctcagctgcttcgcagccatcaagagcaatccaatgactggcacccacagccttgctctgtcttacctcagcaagactcaacaaacaaaacaattcagctagattagcaataatctaaaccactcactgtgggggctggctattttaaagacgcttctatatgactaattcagataagatattttcaatagaaaaagctcactattcatagagaagcggaaattagtatttgttaagaaagaaacaagtttcatgggttactctctgttgaatgctacggcggtgtagacctttatacagctcagcactgacgattgctaatagcttgggtgatcatagcagctgcctgagtgctgtgtttcgtgtgaagcacagtctcatgcaaggttgtaggtagaccccaccatgttaccttctccttgagccctaccatgcttagcaaaagccttcacttcttttgaacgtcttttctgttatttttttccatattttgcattttaatttttatcacttatattttaccttccagactagcattttaagatgggactctggcttcatccagtcttgaaaaataccttttaaaaacccaaacttagtgagttaagatgttaaattatgaatagctcattgtttatgttgggcaccacgaagagaaccaactggaagcagagatcagtgaaggcaggaagctcaggctcccacccagtggtggagaagccatctggtctacactcgcaggaggccttgaggaagtgggtctcactcttcagggagtggtcaaaggtgcttgtggtgcaattcgcgcctgaagatcagggatctgcctgggacaggagtcctagtagccaacatgtcttcctcgtccctcacgctgaaaaataataaaagtggccaaacgcgatggctcacgcctataatcctagcactttgggaggccaaggcaggagaatcacttgagctcagaagtccgagaccagcttgagcaacatagtaagaccccatctctacaaataataaacaaattagccaagcatggtggtgcacgcctgtggtcccagctactcaggaggctgaggtgggagaattgcttgagtccgggcagtcagggctgcagtgagccatgatcacaccactgcactccagcctgggtaacaaaaccctgtctcaaaaaaaaaaaaaagaaaaagaacagaggtacgcagacaactgtgtgtgtgctccctcagaggagtgaagcagtctctgggctgggtgatagcatgaacctgacccctgcccaccatccatctgactcctccgaactcctttcctctgctctcaagcgaggtcttagactaggtcatttctcagtgccctgctatgctcagactcacgtgaagaccctcagccggccagtgctaaagggtctcccacagcccatctgggtgaggagtttggtcactggaaagcactggcagctcctgtaccttccaccccacagccaggctctgctcccgtggcccccactgtcacagtccacttttccatcatgaagtggccatccaagaaagctgctcagtattgctgggtacaaagggtaaatgcctcttcctaatagcttagtgcttagaatctttatgaataaactatttatatgcaatattattttactgaatacatgagagattgaaatacagatgtcaaaaaattatttagtaaaaaaaaaatccatttgtttaagggacagttctagctgtgcttggcaggaaacattatttctgtcataagactttgggtggaggacttccttttcccttggacagaacatgaacccagggctcaggtggttctgaaaactggcaaacagtggccttcactcagttaacattgcccaccatccagctgtccatcctggggcctgattccactctcctggggccctgcgtggtatctgcctggcctcccgagccacataggcagccccgtctatttttgaggcctctgtgtcaagtggggtgccagtctgaactcccataaaacccacagatctgggagactggtcttccccaagtcttcaaaccctggaaaacacaacccactcccacctcatgacagtctcagggcaacagaagggccggatcatctgggcctaaaaccagctgacctcctgagaggaagggaaacacctttcgttctttaatgactagcctgccattgagaaggcaagaaaccactccttttgccatcagctgatcctgctgcatttacacaggagatggctcggagaccggggtctctgggttgggaagtatcatctgctgcctgtggcagcagctaaccaccatgtgggtgagatggtgtggttcttcagtgtgtctgggggcagagggcagaggcatttttgtgtaatgcaggagtcactgcatacatgggagatggaaacgcatgttgaaaaatctctaggcacacctttgagttgtgctccaggggaggataattggattgaggggaatctgccagagaatggtaagttacagaggaggcttgtgggcttctgagtcagcccgaccctggcttgaggcccggattggcagggggagcttggccacgtcacttggccggctggagcctcacttccttccctctgaaagtcagagatgtgtaacggcggccaaatggagacagattgacccagtgtcagcctgtgttgaatgcccacgaaatgccccatccaggtctggggctacctccacactccaggcagatgaaacccctgccctcagggaggtgaaattccagtggaagaaagccgatgaacaaggggagcatgaaaatgaagtggggcctcagaggctactctggggaggttaggaaggagagggaatcccgggatgccgctggagggcagggagggaggcagcaacagacacctgcgggcctggctttcctggcagagggagtctaacatcaaagtcttggcatatttaaggaagccagtgtcacctgagctggtggagcgagggtgagaggatttggaaaggagggcaggagaatgggagccgggcgctagggagcctcgtcctttaggcttcactgaaggtagataagcagcccctggagggttttgagccgggggctgacgcgtcttgattcacatctgacagattctggctgctggagaatggactatggggtggtaagagaagaagctggaagagcagggagaggcagttgctccagaccagggcagagagagacggctggcagggtcgtgggggtggtagtgcaggtgaggggcagtagagagacacggctatggggtacgttttgaaggcagacctacaggccttgatgatggagggctggggctctggcaggcagggaagagtccagcatggccctaagaatgttaccctgaatatgggggtagataatgttgcctgaggagatgcagacccctggaggaagggcaagaagaagaggccagcactgtcaggcaaagcccgagactgtagtgagacttgtaaagttgctgcccagatgaacatgagggtctggagtcagagagagccctgcgttggggatgcagatgtggagttagtgccctaaagtgaaacccgtgggatcccggagtgagctcctcgtaggaccctcccaccatgcccccaacctggctccatgcagtggtgagcatgagttggacacacttgtctggagcatggacagaaaacaagctttccaaagactcaggctggggccctacagtattgagggctgaggaacagaagaaggagccagcagaagagactgggaatgtgcgggcctgggaatcagggcgaaccagcggtggatagtgaccctgacgcccagggtggaaggtgtttcaagaagggagcaatcagtggtgccaaatatgccagtaagtcagtgtgcactagaaactgaccgctgggtttgactgtgagggcaaggttctcgggaagccatgctgcactgtgcttgatacagagaaaggtcaggaagtggcttccattccccttctccttatagctctcaccatcggctgctgtgagtcatctctttcctccagctacttttacactcccttgccttccatctcgtgaggcttccattggcctcctagctacctgggaccattccttgcttccaaaggcagctcctcccatggccagttgccaagtttgccttcccatccttgctgtgctttggagcttcctccacccatcagtcaggcagagtcgcggctgcgactctgggcaagcctggaaataccacgttcctttgtgggccaggtgcagcgttgggcaaccctgggcatagggcctgggccagagtgtgggagagacagaggccagggttcacatctcctcagcgtagtggtcacagtgtggttcctgtgcagccccctgagggggcgtcaggctctcctctgtgacgtcgtgatgaagcagcccaccttgtggggctgttgtgaagatgaactgaggtcgtgtgtgcacagggctggatgcatactcagcatcaagtaaatggcctcctctactaattttttattttcatagagtggtatttcctatttttctttcttcacactttttgctataaagaatttaaattgtgaccaaatactaagttatcttctccagcattacaattattcattagtaaacattgagcacctgtggtgtctcaaatcctattgtcatagcccatttgcattgctttaaagggatacctgagaccaggtaatttataaagaaaagaggcttatttggctcacagttctgcaggctgtacaagaagcatggggccagcatctgcttctggtgaaggcttcaggaagcttccagtcctggcagaaggggaaggggaagcagatgtatcatatgatgtgaaggggagcaagagaggaggtgccagactctttttaacaatcatctcatgggaaccaatagaacaagaactcactcattactgcgaggatggcaccctgccattcatgacgaatccacccccatgacccaaacacctcccaccaggcccccctcaacattggggatcacatttcaacatagatttggaggggacaaacatctcaaactatatcaactaccaggattattggggacaaccaagatgaggaacacaaggcccctgccccagaggagcaaaggacatgaaggcaataccgcagtcccatggcaggagctctcacagaagcacgtgcaaagcacagtgatgcccagagaggggacatccgagggcccaggtggggagggagcactccagtgatattaaaaggagttacagtgtcacatttagggcaagaatcccctcatctttctgatagagaattgtcacgttttgttttctttcatcaaaatgtcgtggggtgatgagcaaaaagacatcttattttaaagtgtgtggtaaccacctgctccaaagctgaagttaattggtcccattatcacggatgaatcagaggactattgctcagaaaagtcagaataagtgactaatagctccccacgtgtgaaaccacctgcctctctcaatggtgttcacctgtgattttcttatttgcagaacctcaagttttcaagctattcacaatgccagtgcccgtgtcttgttcctgttctgtggttatgtcatggggagttgggaatgaccactctgtcaaagccaggaatagaaacatgaaaccatgaaactttgcatgttcccaatcgcactccttgtatggagcacacctttatctcgggcaccacattctaggttctgctggatgttagaatagcactgggccatgatggggtctccggaggctggaaagtgctggcatttaccatggctgggccatcttttcagggcggtcacgtctgatgtacagccctaggagtgctctcaactgagtaagagtcttaacttctagaagctggcttacatcaaaccactaagccttgccctccatccacacagctgctctagcaggctgcatcctgcctacctgccctctcccaggtgtgcacagtctcaacagcctgggccacactgttatctgcacaggttacaggagctgtctgcttgcccttgagcattcaggtgtttctctgtgcatagctcccgttagcagcatgcacttcagggacacgagtaaacctcccagacacctgctgaacactcccaggatacgcctcccaggatacacatgtgaaatgaatggacagaattcctatttaaatatccttgggctaaaggacgctgtatgcatttctatttctgcctaacaaattaccacacatttggcagcttaaaacagcacaagtgtatcatcccacagcttccgggggccagccgtctgctgtgctttagctgggtctgagactctgctcatagtctctcaaggctgaaattaaggtgtcccctggctgtgtgctcatctaggggcagatccataagttccctgcggttggcagaatttagttccttgcagctgaatgactgaggttccattttcttgctaactgttggtgcctagagagtacccaagagactcaggagtgatgcaggttcactgtgcgctgcttccttgccaagtctcatgcatgtgtacaggttgcacaaagcaggtgtcttacagacaggcagtgagggacaatagcagcctagggttcagggtaagacagtcacacaagagttaggacagtgcccagggtgcatgctgtcttgtgctgcagctgagggaccccagaaagcagcctgctgtgggtttgatacctgggggatacagtcattattgggctaaaacattgaaatacatcctgttctcggagggaccagaacagagtccagactggtccagctagtttcccgtgatctcaggatactgcattcccagcacattcttttttttttttttttcctggagacagggtctccctctgttgcccaggctggagtgcagtggcacgatctcggctcagtgcaacctccaccttctgggttcaagcgattctcctgcctcagcctcccaagtagccagaactacaggtgcccaccaccaaacccagctaatttttgtattttagtagagtattttgtatgtagtagcatgttgcctacagtaatgcttgagaactacaggaaaggggaaagaacggggtcagtccaaagccatccaggaccccacaccacatccttgccgtctagctctcttcttatggcatggcagtgaagttgtttactgctttgggttgtttactgtttggcatggcagttgtttactgcttcaagaccagccagagaatctctcctctctccccctttccctcttccctcttccgtattccctttatattctaccatctgccctttctctgtaaatctctctgactttccttttctctgaccactaaaccctcttttggtcctcagattaggtcaggccaacccaggataatctcccttttgatcaactcagagtcagtgaatagtaaagtaattacatctgcaaaatcccctcactttaccccatattataacctaatcacaggagtgacatcccgtcggagtcacaggttccacctacacccaagggaaagggatgacacaggagtacaccccaggaggtgggaatctgaggaccactttagaattctgcctgccacagatacagtgtcattacttgcagtatgataattcttctatgctaaaagatccagaatgagagattaaatcatactgaatatgttgtggtcaggggaatttttttgatttcctgatgtgccacttttaaccatttcacttggattggtatgttacagcacactgtgcctagaggcaggcatgcatttggactgaattctacttttttttttttttttttttttgagacaaggcctcgctctgtctcccaggctggagtgcagtggcacgatgtcagctcactccagcctgtgtctcccgggttcaagcgattctcctgccttagcctcccaagtagctggaattataggcatgcaccaccatacctggctaatttttatatttttggtagagatggggttttgccatgttggtcagtctggtcttgaacccctggcctcaagtgatccacccacctcagcctcccaaagtgctgggattataggcatgagccactgtgtccagccagaattctactcttgatggcttcaaatttcaaacagcttgtctctgagccctccaaagatatcataccctttgattgggctcttttgacaatcagaaccatggatgtggtcatctgggataggatggggtgggcactatggcaactatgcttttgataatagcagccttcacgtattggggatctcctatgtgctaggtgtattatacgccattttaattatgtccagatctcacatcggctgcatgcaattgccaagatgctcttcattttacagaacaggcagaagagacttggggaagccgaagggtttgcccatggctgcctggctgtgaaatgtcctcatcctgcccatgccacgagacctcctcagttcagctcagagcgttgggaactgtcatcctttccctcaggatactttctgccacgtgacccattccaaatatgaattgcatgatttattggattttcttaaaagaataaatcaccaataccagagaaaatctccaaaggaacactctttgagaggccaagtagaaagccagcagccgagttacacaattctagagggacacgttgctgagggcaccgcgcaggaacatctgacagaggcaaagtgaaggggggtggcccagggcgcccacagatgatgggggtggcccgggaggcccacaaatcacggcagtccccaagctttacatttaacactcctcacacagagtgactgatccccaagtcctgtcaggaagaaaatcaaatgaagttatcaaatttttaggagtatatggtacgtacagaagaacagttcacaagcccaggagacttcagaccaagcgtggcaagaagcctaccttgcggcagttccagcacagctgagaaagcgtaaaggaggaagcattttgaccatttttgtgactgactgttacacattaaccttctttttagggcaaacagagttagtttaagctgatttgtctacagctggttcactgaatcatgtggactagccaatgttttgtgttttgtttatgattagagctaatatctcggggaaatcaggatgacttaagttttggctacatggttataggtggttggccttggggtgtgtctgaactggggcctctatttttctttaacagtcctgtaaaatgcagggatacataatgttactgatgagctattacccaccaagactgaagtttggaagcaagtcatgtgatgaatctgctgtaacagagctcgtaagatcaaaaaatattcattaagtcactattgcattgtcattatgttctcacttttatttttgtgaggaagaaatagaaatctgtttgttaatctaggtattggaaatgaaaagcatgtgttcaggtgggagttaaggaagggttagaaaatagaacctttagatgtcttaagaagtggtaaaataaaactggcagtgtatcagatccatgagaagccagcctgttcaacaattctgggtaaaaataagaaacatgtgatgttaaagcatatattaatgacaatatgtagtcacagttttatgttgtagccttgtttatagactcagtcagcatctaaggtaccccttaaatatttcagacatactcttttgcattttatggaaaaaataaaatgaggtgaaaatatttgcaaattggggttttctgaagacattccatccagcagattcaccacctgaatcctttctttgccttcaaaatgtcatctcaggttcaagcagcttccagctgtcttttctcttagagtcatctctggagctagacccattaccctttcattgttttaattccttattgaaatgtacatgtgggaaagtgtgcaaatcataagtgtagaacagatcacatcctataacaaggactcagacaagaaactcacatcaagaaaagtgacttcttatagcataggtttattttgcctctttttgagctttatataaatggaatcatgaatgggttaagttctggattcttctgcttatcattaagcttatgcaattcattcatagagttgtgtaattaccatatagcttatttattctcattggtgtattgcactgcaatgtatatacatgtattacaaataacttctccattatgttattgatggattttttggtgtcttagctcaggctaacataacaaaataccatagaccaagtgatttaaatgacagaaatttattttctcacagttctagaggctagaagtcccagatcaaggtgctggccaattcagttcctggtgaggattctctttctatcttgtaaacggctgccttctcactgtattctcacatggtctttcttcagtgcatgccttggggtgggggacagtttgagagttgaagctctctagagtcttttatacaaacactaattctgggagatcagggccccacccttataacctcatttaatgaatttaaattacttccttgaagtcttcgtcttcatatatagccacactggtgattaagatttcaatatgtgaatttggaggggacacattcagtccataacaagctgttgcaactttgtcattattataataaaagtggggtgctatgaacattcttgtacaggtttctggtaagccatgaacacatttctaaagatatatacagtcatccctcagtatccatagggaatttgttccaggaccctccagatactgaaattctcagatgttcgagttccttgtagaaaatggtgtgctatttgcatataacctactcacattttcccatatattttaaatcatctctagattacctgtaatacctaacacaatgcctacatcatttcatccatgtggatttgacatactatttggcacacagcaaattcaagatttactctttggaactttatggaatttttttttctggattatttctatcagcagttggttgaattcgcagattcagaacccacagataacagagggtcaattgtacttaggagtgatattgctggatcataggatttacatatgttcagcattataacagttgtccaaatagttttccagagtggatgtaccagttgctcttcctctgttgagagttctggttgctccatgttttttgtctttttgttttagttactgtgttggaagtgtaggagtatccacacagtggttttaatttttattttctgatgactagtaaaattaggtacttttcatgttattggccatttgcatatcctcttttgttgggtgccttttcaggttttttacccatttttaagattgcctttttgattgacttgtgggaattatttatacattctagatatgggacctttgtcaggtgtgtattgccaatatcttcacccaccctactggttcccttttcactcactgactgatacactttgatgaacagaagatcatgactaaaatagttcaacttaccttttttttccccttacttgagagcctctatttcagcttaagaaacctttgcctaccccaaggtcctgaaaatattctcctgcctttcatacttaaatctataatccacctaaaagtgattttcataaatgatgtgctatgtaatgaaagtccattttcccatatattcatcaacctgacatggtaccatttattgaaatcatcttttctttattatgctgcagtgtaaccttgagatacagcaggtgactgtgtaggtgtgggtctgattctgggtctgttctgttccatcaacaattttgatgttattcttctttatcattaagtttaaatcattttaaatacttattataatttttcctttgactcataaattacttagaaatatgttgcttaatcactgtggggatatttctaggagtttttttttctagcttaattcttctgtggtcaaagaatgtataatgaatgaattcagacattttaaatttgttgagacttgctttatgacccagcatataattaagcttaataaatattctatgtgcacttgaaaaaaatttgaattctgtccttcttaggtatagtactttttatatatgttaattatatcaagtttgttaattttgtcgctcagatcttttctattcttcactaagtttttgtccacttattctaccagctattgaacagggtgtgttaagatctcctactatgattgtgtttctctgtttcttccttagttatcttttgctttatatattttgaaactgtgttagtggatgcatagacacttagaattattacaccatcctggtgtaataacaaaactaaagttttgttagatgcagccctgatggcagtgaagtctcaggttttcatttgtctgaaaatggcattattttactttcatatttaacagctagttgtaggctttacagaccatgtaagttctctatcacatattcattctctctttctctttcccttccctctatacctcttatagaccaaagtttactgactcctgatctatattattttctccctctactttggatttaatcactgttcctttgtaactttttaacatggatgattaattcattaattcctagcctttctttttaactcttgcaagtatttaaggttattaatttttttctccatactattttagctatatccccaaaattttggaatgtaatatttttgttattacatggtttcaaaatattttctgattttcattttggtttattatttgacccatgaattattgtaagtgcttctttgtttgcaagtatgtaaaaactactaaatatttttagttatttttattatagatttcttacttccattgtggacaaaaagcattgtctgtatgatttgaaatctcttgagaactttgcttcacgattcagaatatgatcagtttttttaaaatcattccatgtgtgcttgaaaataatgtttagtcttctgttttggctgcattgtatttgtccatttggtcatttattatgtttttcacatcttctgtacatttattggtttattttttactttttctctcaattaccgatagagatgtgttaaaatctttcatcatgattgagtacttgtctatatctccttttattcctatggatttttaatcctgcataaatataatgctatgttattgaatacagcaattaaactgatttcttcctcatgaattgagcagttgaacagtgtagagggtgcttattaaattctactaatgctttttgccttttgatttattttatctgctattgattcagctatgttagctttccgtaagttaaaacattcctgatgtaccatttgccacctttcatacctttacctatagcacttttgtattcctctgttttagatttatctcttgcaagctgcatgtagttaatttattcataaaatcagtttcacagcctttgtcttttaacaggtgcatttatttttaatgcaattgccattttcccccattcaatgtggtgtttattctctccttacacatcttcttttaaatcaattaaatattgtttaatcatgtctttttaaaaattctacaagttttgaagttataccctctctttccattattaagagtttacccctaaaatatgcgtatgaatcacatctcaaattaattaacatcttaacctactttacacccaggcaagacagggactttggagtagtttagttttattcatccttattctctcctgttttgtaagttgttgtcatttattttagttgtatacttttaatctcatcagacattagtgttttatatagtcaacattcattttgatttacccatatgcttaccttttttgtttctcctcatttcttcttgcatgtcagatcttccttctgtttgaagttcatcctttacagtttctttaggtgagtgctaattttactctctcagtttttgttagtcttaaaatgtctttgttttgccctcattttttgaaaacacttttcatgggtctagtattatagattgccagttattttcattcagcacattgaagatttttttttttttggcttcttctttccattgttcctttgaagaggtaggctgtcagtctatcactcctttgaagataatctggtttttttctttctctaggtgctttaacatcttttctccctgtcttttatattgtgcagtttcactaggatatgttaaggaagacattaattttattgttcttagaatgtcttagacttttaaaatctgtgagtttatttttacatattttggaaaatcctcagtcagtattcaatattgcctgattcatgcctttctgaattttgattggacaatgttagatcttttcagtctattcttatgtctcataaactctcttgcatcttttctctttccctctttgttgcttcttacttatcttcaaatgtattaactttttccttcaacagtgtccaacctgatattaaactgattcttacttttttactttaatttttatatctttcattttaagttctatatgtgttttccaaatctgcctcttattctttggtcatattttgtttaattcttttgtgtattttaaacatttttaacatgcttgtttacagtctctaatcatttttaacctcaagtttataggtatctataaactgctgattttgtgtgtatgactcttactcacagtggcttgttttctgttgtgtttgtagttttgggttgtgagcaggatgttatatgtgggactcttgtgtggcctgtgttgagagtgtactcctcttagagagattgtttttgtttgtttgtttgtaccagtttcccaagaggaattacctttggtacttagaaccaattttaggttaatttcttggcttactggttccaagccacaaatcaatttaggtcaagtcttcatgacagtcaacatttccggggaagtttttattttcctctgctaagcctaggctaaaagagacaaattttcttcccaactgcctttgccagagcaaaattatttctaatctttgcattcaggatatagtttttgaggatcctaactctatatggaaggaaaaggccatccccagtcccaattccccacatttcagggtctccagccttttttcgagttcttatgaagtgattaaacagttaaatgtcttcactcgttggcagttgctggtttggtgcatactaatttccatcccatatttatttccggttgttggagatttactacactttctttcaagcttggatatacatttgaaaggattattgaaaataagtatttttattttctgacctcttttcctctttaaatctgtgccctcctgctcatcttagggagagggatttctcttttcaaacgaccagagacaaagccttcagcccctactttatctgcagtgctacacgcattcacacaagatcttattttaaattattttttgctaagtattacagagaaatcaggaataaataagcatagagtaactaacaaaagtaaaaatcaatgagggtttgtagggatataagaaatcttttcattggtttttaaaagttgctttctttggttcattaggcttaacacctaaaggccaggtctttccttacattcctcacatggttccttttcccgaagatctactcaacttttttctttaaatcttttttatcctaatactacaatctaaccaatgaatgtaggcaaaaaaaaatttaacatgctgtatttagatgtctacccaattcaagagtgtaatttgcatttctgagaacctctggacagtgcttctcaagcaatctgtgttgaaggacaactcttttctttagatttccaattcactgtctccctatgcttctataaaatttaataaaaatattacagcaaagcgcattgctataaaagctcctaaacacttcctcccattttctgtacttgcctcattgtgcaccagctgacctccctttaagcagcaccaggcactctgtgtgcaaaagcttccctttatttgcagttcatagtctttcttgcatgaatgtcagagcagttgtgcttactctaaaaaggactttggtgtataaaggtaccttttaagccaaagcattttggttcactcattcattcattcattagtatatgcataaatatactcctttatttaactcaggattttggacctgtatatgcataatacatatatggggctttctatatgccacgccctatcttaagtactttcccaatattaaataatataatgttcataaaaactctgttagatcaggactattattatctccatttttaagaattgaacactgaaacagagtggttaagtaagttgcccaacaccacactgctaagaaatagtggaactgagatttgaacccaggaagtctaactccagcttctgtgcctaaccagtctgctggctgcctctctgatgactaccttagacactctagtccagattctgcaagggtaggtgttccaaagcccactatttcatcctcattttcaacttgaatcagttggtctttattgcacagacctctgaattgaaaagggaaatcaggtctttcacctcctttgtgggaagagtgatgattggttagcgtgtctgccatggaaagtgtggtgatttttcaatgctgcttgctatggtgtagaggggattgacagaagacacttcagagaagtcacctattagcttcagggctctgtgccttcaaaaaaattgaaaattataaccaaactaaaaatttcaactcaatctattgaaacagcggaaaaatttagtcaaactagcattagtttgcattagttagattcgcccaaaatatttttaactgaattcaacccatttttaaaacttaatcgagacaaatgagttaatttacatagaaattgtctttggcaccagaacagaatgtctccattgtaagactatagagtaaacccacatgccatttccttcgtcttgaacatcttcacatctacaggaaaattggaagatgagtatttatatatcttgcaccaaaaatcaccagttttcgggactttgtcacatttgctttatctctctttatgtgtatggaagtacatacactttttctgaatcatttgaatgtgtattgtggatacttcacttcttctgaaaataaagacattctcctatatgacttaacagcattagaaaattagcactaacttagtaatgtcaactagtagagcccatactcagattttcccaattggccccaaagtcatttttgtaatttattttcattccaaaaaacccaactttatgcgttacatttggttgttatggctctttatgcactttttgaaaaacattctctcttcttttgtttttcatgaaaatggatattttaagattcccagccagttcacgtacaatggtcatatctcattgttgaatgctccagtggggttaattcctcacccttctcccaagtgtagacctcggggtcatatgaccctgggttactctccttatatctgtaataaaggctggaacaagcagaggccctgctgatctgcacagtctgtagggataggaaggggaaagtcctgctatgcctagacactggcagtgagccaggttggggagagagaaagctcaagggaaaggaattggggtgtggggaggaaggaatatgggaggaatgggataacatggatttgaggcacttgctcattatatggacccattggatagccactccccacctaggaataacaagtcagaagtcttaaagaagaatcctcagtctctactgcaggggagaggccaagccagcgcctccccagaaccggtggcagaggaataaacattgtgtacagcacatattcgtcagcatttaatagtatcatttatctgaagatttgaatatataatgtatttttaaatactgtcttcatgtgatataatgaaaaaaattgccaaattcatgttggtgttacagcgagggaggaaggaatgagagtgaaatgggggaggcaaatagagggaacttcagcttgatctttactcgtttttcttttcttttatgttgaaaggaacctgctggtgcaaatatggcagaggggtgacattcatttggttttgggtgatgggtgtgtttcttttggcactttacaaaatttgagctccagttttgctcgttactcagtaatacggcttttgaaatcatataggtcagagaagttaaaattggcttgccacaaactcaaccataacaaacaaaattagactggccttttttgtgatctgattttgtcctggatgtgtgagggctcctgttaagggtcagcggatcgtgggcaagtttacttactccctgtgagcgtcagtttccttctctgtaaaatgggaataacatcccctgacacagagctggttgatttattgaaggtcctgcagtgtgcaggagaacacactaacccagccagcaggagcttaaactgtgaggtcatcattatcccacacaactcagagtctgaaaacagggatgttcatggcagggctggcagctgcacagtgttatggaggacccaggcacacatagcaccctgctcttctctccccagcgggtcagtgctagctccagctggggatgcagtgtagctgtggccgcatcaggccacacatcctcacactgcatcattcagggcagcaagagagagcccctgattgtggcccttgtgaaggaggagcaagccccagcaggtctcctgttacatcttgtgagccaggcgacagcagtccatggcaaggggagtggaattgcacagatcgtcttggacgtatgaacatttgcacgttgccccatggggcaggcaaggaggcttgcctgaaaagccccagacacaagcagggcgctgtcagcaaggatgggagggaaacgctgtggggcgggcaagacaacgaggtctgccgcagaaatgcagaccacctgcctcattagcatattccctgtccctcctctccctgattgtctactcatgttccctatactccctgatggttgcccagagcactagcagctgagatcaatgcagaggatgaacaaggctgcccactttggtgtcaaatgtgtcggatttccaggtgttacagccattttgttgagttttatgcctttgtaagcaaagatcctgccattttattttactctgtggcaacccagttttactgtatcccagcctggttgttataaacactttttaaaagtcaagtgagacaggttgctatttcacagcctagagacaaagaagtgactaagtaactgcgtgttttttccaatgacgtccacaacggtccatccagtggtagtgtcagttaaagcccttacttgcatttctcatttagctttaataaggtgacttgtaggtggtaagaatataccaatttgttagtgtaagcattaacatcttcatataataaatagatgttcgtctacttaactttgtagtgttaattttaatacatgcttttatttagaattaagggcgcagttattttttatcagtaatgccacttattacaatggaatcactgaatcttaaccaaaaagcgctgaagagtggataaggattcagtttaaacaaagaaccaagaagtttttttatattaaactttgttaatatggcaacacattaggcaataactgtctgactctaaaataaatatactcctgagggccttaattttcaagcttactcgcagtctttatccttcatatttcattatttctattctgatagaaacaacaccttttattaaaattagatatttttatttgtacaaatttatggggtatatctgaaatttcgttacatgtatataatgtgtagtgattgagtcagagtgttcatcacccgagtacaatacatttttgttaagtagaatcaccctattctgctatccaacattgaatgtattccatcttactgtatgtgtgtaccctttaacccacttctcttcatcgtccctcaccactcacccttcccagtctctggtatctgtctttgcactctctacctctatgtgatcacatttctaactcccacatataattcagaacatacaatatttgtgtttttgtgcatgatttatttcacttaggataatgacctccagtttcatccatgttgctgcaaatgaatgacatcattcttgttaatagctgaatagtattctcctgtgtatttacacgttttctttagccattgacagatggaatgtagaaatgtaaaacatgttctgcttcttcagttgttcaaatcctattaatatttctctcttttttaaagaatttttgattaaaatgcttttataatttcttggaaatatctattataaacattctcatttgattgaagttcccaaagtgttgaaggccctagggaggtgcatgttatatttcatcctccaaataaaaacatatatatgtcactagaagtttcacataacattagaagcttgatacaaccactcataagcttgaagcaatttttaaacaattttagtattatccaagaagtgacatgtaagatgacatttgtgtcacctgcctaacatgtaaatgagccaggctatttatcctttccatagacacattcttttgaaaagcagccatgagtgcagatgcacctgtcatcaggtaggatagagtctcctgtagccatcagcctggagattacctttgcctcgcttctgtgctattcacccatttccctcctgtttcctgtatttctctggttttggtttccaccctcattttgtggagtacatcctcctgaagcttcctgagaaagagtgaatgaagatgtcttgacatgagttcactagaaaacagaacccggccaggcgcggtggctcacacctgtaatcccagcactttgggagactgaggtgggcggatcacgaggtcaggagattgagaccatcctggctaacacggtgaaaccccgtctctactaaaaaaaaatacaaaaaattagccaggcgtggtggtgggcacctgtagtcccagctactcgggaggctgaagcaggagaatggcatgaacccaggaggtggaggttgcagtgagccaagatcgcgccactgcactccagcgtgggtgacagagcgagactctgtctcaaaaaaaaaaaaaaaaaaaacaaaaacagaacccaaggtaactcccaatggctatttatttcagagacacagtcccagatgtgttagcaactagttttattgagaaataaggctgctctgaatttcttatatgagtcttatgttttcatttctcttgggtaaataaatatccacgagtggaattgctgggtcatatggtaaaggtaggtaatagtccatttcacactgccataaagatactacctcagactgggtaatttataaacaaaaggggtttaattgactcacagttcagcatgactggggaggcttcaggaaacttacaatcatggcagaaggggaaggggaagtaggcaccttcttcccaaggtggcaggagagagacagcacagggaaaactgccacttttaaaaccatcagatctcatgagaactcactcactatcatgagaacagcatgggggaaaccgcctccatgatctaatcacctaccaccaggtccttcccttgacacctgggcattacaattcaagatgagatttgggtgaggacacagagccaaaccgatatcagagtatgttgaactgtattagaaattgccaaaagtttttctaaaataattgtgcctttttacaatcccaacagcaaagtatgaaaactccagttgctccatggccccttagacatctgtgctagtatgcaaaatacaattgactcttgaacagcacaggtttgaactgcacaggtccacttccacttatatgtggatttttttcaaccaagtgaggatcaaaattacagtattcacaggatgcaaaatccatgtatatggagggccaacttcttagacatacaggttccacagagccaactatcagacttcagtatacacagatttgggtgtatgtcggcggggtcccagaaccaatcctgtgcagatacttggggatgactgtaccattgatttgtgtatattgatcttgtatcctgtgaccttaaaaaattgcttattagttatggttttttgtagcttccttatgattttctgtgtgaactatcatgttctctgctaagaagaatagtgttatctcttcctttctgatttgcgaatacagattttatttctttctcttgacttatttcactggctaggacttctcatactatgttgaatagcagtggagagagggcgcatctttgtctttttcctagtcttagaggtaaagcattcagtctttcaccattaggtatgatgttagctgtatgtttgtgtagattttttaaatcaagttatggagatccccctattcctagttttatgggaatttttaattatgagtattgaattttgtcaaatgctttttctgtattcatgatatgattatgtgatttttcttctgtagcccattaatatggtgaattatattgattgattttcaaatattgagccatccttgcatcccttggtcatggtatatagttctttgtatatgttactgtgttctacttgtttgtattttcttatgaattttgcatcatattcatgagagatgttactctgcacttttctctctttgtactttttttgattttggtatcagggtaatgttggctattttctggaggagcttgtgtaatattggttgttgttaggtatacctcttggtataacctttttgggaattgttctagttattacattatatacacatactttatcaaagtctattggtgttgacattttactactattggtgaagcatataaaccttacctgcctttttgcttctttattctctaccatttataataaaattgttttaaatatttattcaacatacattgaaacatataaacagataggcaatgtcataatttttgctttaaccatcagacataatttagaaaactcaagagaagaaggaaagtcttattatgtttgcccatatttttgttctttccatgttcttccttctttatatgccaaaatgccttcttttatcgtttcctttctgcctagagaacttcctttagccatttctttaaggtaggcttgctaggaacaaaatctccttgcttattactgaagaatatttttgctagctttaaaattctgggctgacagttattttctttcagcacttaaaaaatattatcttggctgggcgtggtggctcatgcctgtaattccagcactttgagaggccaacgcaggcagatcacttgaggtcaggagttcgagactagcctggccaacatggtaaaactctatctctactaaaaataccaaaaattagccaagtttggtggtgcatgtctgtgtcccagctacttaggaggttgaggcaggaaaatcacttgaacctaagaggcagaggttgcagtgagctgaaattgcaccactgcactccagcctgggtgacagagcaagactctgtctcaaaaaaaaaaaaaaaaaaaatttatcctgcttccttctggcctacacggtagccaatgagaaatgcactgtctttagaattgtttttcccatataagtaaggcgttgtttctccttggcagcttttaaggtttctttgtctttagtttttagaagtttgactatgatgtattttggcatgagtttctatgggttttttttctgtttagggtttgctcagcttcttgaatctgtatgtttgtttgttcatttgcaaaaattgggaaccttttagtgatttagtgattatttctttgaacactttttttttttttttttttttgatacggagtctcgctctttcacccaggcctaagtgcagtggcgcgatttcggctccctacaagctccacctcccaggttcacgccattctcctgcctcagccccccgagtagctgggactacaggcgcccgccaccacgcccagctaattttttgtatttttggtagagacggggtttcacctttcaccgtgttagccagaatggtctcaatctcctgacctcgtgatccgcccgcctcagcctcccaaagtgctgggattacaggcgtgagccaccgcgcctggcctcttcgaatacttttttagctctaccttatttcgcctcttctacggactccagacttttgtcgcagtcccacatgttcctgagttgtgttctgtatatgtgtttttttttttaagtttaatttttctctgttgttcaaattgggtgatttctatgttatacctttacattacactgattctttttctcttctctccaatctgcttttcagcacatccattgagtttttaaaatcagagttgtatttttcagtccctattatatctgcccatatttttgttctttatttggctctgttttgtatcttctattgttttggtaagactttctatttctttactacattttctaatttttcatttgtcttaggtatgtttgtaattgcttgttgaagtattcttaggatgactacttttaaatcccagtcagataactctaacatctgtcatctcagttttcatatcttttcttgttctgtttgaaatcttcctggttcttggtataagtgattttttttgtttgtttaaaagggtatatatttggtattaagttataggactctgggtcttacttaaatcttgtgttttagcggacctcctgacaccactctggtaggttcagggggccattgcctgacaactgccagagggtaattgaagtacaggttccccctctgcccctgttgatacctggggaatgggcttggtacttcttggcaggggtacttcctagctgagaggaggcagagattctcattacagccagatgagtgtgaaagttcaggctccctgtgtgtcctctgaagatagagggcaaggtgcttattaccacccagtggggttgaggtcttggctttgtactcagccttctctgacactccccaggtgatggagcaggcagtgatgagcaccttgttacagcctggtgagggtggaagtctaggcttctcactagaactttgctggcaggggtggtggtcgggttataattttttctgtgatgtttggctggaatagaagaggaaatgtctaagcagctactgttttgctaagctacccctttcctggtattctgtctagagagagcatgctttttcttttctatctttttttttttttttttttttgtggcctactctcattggttcgtttttacagtatctaatctgggatatgtgaggcaaaaagaaactccagggaacccaccattatgtcgttcctcaagtctcaagatccctagttagtctgccacttcttctccacttttcagagtcttctaatatgattttatacataatttccagggcttttcgttgtacttagtaagagaaataggaaaaagtacatctgatctatcttccctgaagtggaagtctctaaatgtaaatattcatgaaatttaacataactacacctatgtaactataatggttttgatgaatcaaatgaaatatgaactatactttcaaaggtatgtgtgcctcaaaaaagcaagacggtgaaaggaaaaaatagctttcaggagggaaagctgtgttcaaggaaattacaaagaaatgttttatcttgtgtaaaatacgtttccagattcaaggagagaaggtgctggccttgagtttcttaatgctcatgctaattgatgggaggatttggccacttcttgtcctcaaagggaaaagaaatctatattttatttgaggagagaagtagccataatgttccccctttctattgaaacctgtagaaaatctgtccctgatgtttatgcctccttagcaaacacccccagtggccccttccttttctgggatcctgttctaaagtgagcttcttttccaggtcgcctgaactggtggtccactgtgtgcacgagctgtaaacggcttcttcctctggccacaacaggggatgggaactgccttttacatgctgcttcactgggtaagctccacagcacagacagagggtggccaggctccaggcctgcgtaaggaaagacatatgctattgaaggaaacactattgaaggaaaagcatacactaaatagagtcacccatgtcactgtcatgagaaagtccccaggagacagagccaacaatcctggcccttcttgtcaagtagcacttgctggagagacagaacacacataagaaaagacctggcgtgatagaaggaggccttgagcatagctgcagggatgggacttagagaccgtcgcctggtacaaataaaaaggacttcctgggaggaggtgggatctttactgaaacttgaagaacttgagagactagaagagggcattgcaggcagggagaccctgcagataaagcataaaggcaggaatggacagggtgtttggaggtaggggtgaacgaggtaaagctggagtaggaagttttgggagcagtgcatgaggttgggtaaatgagggtccactatgttgacagcagtcaacagttggcatggactaatggaaacagacgtaggtactgctcagataaatcacaggggagtcagcatagtcagaatataccacagagagatcagcacacttgtccaatagagacgtgagcttcccgatcacacaaagccacacaacacagaaatatttggataattgaggatcatcatcgactttctggaacctcagttatccctttaggcccagcgttatatgcacaaggctgaatccattttgataggtgagtctgggtttgcaccagggaccatcagggccggttggttcttacccgccctggaggatagcgcctctccaaaacacacaaccctcacacaggaatgcagtccttgtttgtcaaacttgcatccccaacaaacatggctttaactgggtgccatgacctacatcaagggccagcccccagacctctctctctttggacctgcggtgaggcctattcagcaagaggtaggtgagataagactgtaaagggcttcaagggaaatacatcagggtcttgaagggttccagaggaggatggagaacaagggaagcattccccaggcttgacctgcagtgaggaaaggcaaggcagccacttacctgcttcatctccatgtcattggagcacattctgcttgttggcattgcaaaagtactccacattcaccatggtgagaaaatgaaaatcagcgacccccacccagcggcggccactcttaacagtttggtattgtcatcatcttccggtcttttgtctgttcttcaggtgaaatgatgatcttgctgtgttcacagtcttgaatccaacattttcccttacaatctgagaattttccctgctgttatccttcaaacacatgattttaagtagttgggtcttattttatcatagtggataacattaactattcccctgttattgagcatattttgccttgttctttctaaaacctggagaaagaatctaaaagaataaatctctcatctgtgtcaaacagcagcctcattgtgaagtctggggcatggaaatgtttttgtccctcagcaactgcagcatgtagagtcattgtccccatcagcacaacagcggggcaaggccacaccccacagcattttccctgtgagcacagtgggcctcccaggcctgcctgggaagagagagcctccctcaggctggtcatttccatctgcaagagagcctgggccatgactgaccagggctgtgagacccccctccaagaatcccctgtacaacaataagcccagagctcatagcaatctgtcctcttatcccagcactttgtttcattttgtgcccatatagctaaactccgcaggactggggctgcccaaagctgccacatgacattcaccagcagtccttgtggaacccctgttggcctggcctgacgttgagctaggattgtggggcacatatagaaatgacagtcatcttggagtcaggcctgtaggcagatatatgcaggacaaggaggccatctctgcaagagagacctgcccaaggagctgtgggagagtcccagaaggcagctgaaagaggtctgaggatgagcgaggagtgacagtggtcattccccctcccctgccatcctatagaaaaaggcgaagccttgctggctagaagcctgtggcaggcctgggctattgcatatccaaagatgcccagccagttgagcctttgaaaacatcagttcacattactctccttctgtagactctccagaggctcacagttccctcgagagcccccttttcactctccctctctcctcgatcccactttagccacctttccctcttgccttttctcaagtactgccccctctgggtctgtccctggcctttccctgtgctgggacagcaacttggctccttcctccacccatttgagcctttgctcctatgtctccattcacgccacagcagatctgcctgcctcacctctcctcgtggggctgccaccctcaacatcgtacactctgtgccagcctcgtggctatcctcacttcccacttccccacaacatgtgctccatgagattttaggaacttcatgtgtcccggccactgccacatatattcccagcacctagaatgagtgagtgggtgcgtgggtgggtggatggctggatggacggatggatggatggattcccctgtgttttcccttgtagccagagctgcccttctcttgagcacttctcccatgagttggggttcttgatcacatctaagctgcccagagcacattctcagagatggctggtttctctctatatcctctcagcacctggcacagggtgagaccctctcactaggaagcaggcgctctctcctgggccaggtgtgtgcagtggtgtcactgacgctctgcttctcaggaagctgagatgcctcagggctggagaggagggaaatggcagaccctggagaagccaggatgctaatggcctccctcacctggagccctccataaggacactggacagcctgtccctgtcccctagtcagtcccccacccaaatgtaagacttgaataatgaccattaggtcctcaaagcaaaccagcaacattgagaatgggttgccaagggcaccagagaggaaaagcacttgattttcacccactattgttttgctaagaacaggatgtgctgcttcattcacctagttgccttaatgggaagcctcaggaagaaggctggaggggaattaacagaaccgctgagtaaggaggctgttctgcgtgcagacaggaggctctcccagtgggtcgtggtagtttgcatcacctctggcttgtcttttctcatgtcctttctctcctctgttctccctggcctcctggctccaggaatgtgggggtttcacgaccgggacctggtgttacggaaagctctctataccatgatgaggacgggagctgagagggaagccctgaagcggaggtggaggtggcagcagacgcagcagaataaggaggttggtatccactggcatggccagagcccgggacccaggccagatgcagcctcgggccgtggtcgagtccacagcatggcctccaggccccagacagtcttatgaggggaaggcagaaacagcccctgggatcaggaaagtctcctgcttttaagcccacagaggaggagcctgttaaaatagcagagtcccggcagacagcaactatgcgtccacttgtgcttccttaaggcataatcatgaaagctgcctaccttcattcccaaaagcatcctggcttggatgatgaattatatatatgactgcctgctgtcaggtgcagcccatggccccagcccctgtgtgtgagctcagtccaaagggattcccgattgtccccaaccatggtaaacatgaggaccttgctctcctagaagaatctgaacggccagccccagttaggtgcaggcacaggttaatgctcggtcatccccagcccctgagaatgacccttgttggtgggcagattcccagcagctctggaattagagcttggggcttctgaaaatatattgtgcatagcaaaggtggccaagagggtgcagttggtatagttggtagctacctacagatgtgcctggcctgggtcccggtgaggctggtccagattgggagggtgaggagaggagggcagcgcagctgtggcccaccccccttctgagccggctcccctctgccagtcagggctggtgtacacagaggaggagtgggagcgggagtggacggagctgctgaagctggcctccagcgagccgcgcacacacttcagcaagaatggcggcacgggcggggggtaagtgctgcccctgctctccccagaagtcacctccagctccaggccacccagggctacacacagcatggggggatggcacgggggggaatgtgggactcttgtgctgtggaagacagaaagattccagctttccagcattagcttcaagacaaggacgcacgggaggaccgtgggtgatggctggccccgccaggtgctagtggaagggtatgcagcccccacatgcactatgcaggcagaggtgagctcacatgagctgcctccaggccactttccttgaactttattgtgcacaacagttggggtgtgcgccttcagggcacagcaggcctctggaggtcacacgtgatggtgagcattcccacacattgccatcgcacgaacctggctctgaagtttgggttttctcccccaactaattaatttgtggcttcaagaagttgccctgaaagcagaagctcattaagctagcctggtgtttcccagatgggctccatggatattatatgtgttcccagcaaaaagacttcacatctgtgcatgtttaggaatagcttgttcctacagaaacaccttggatgttctagtatggaatgaagaccgtggccagaccagtggggcagccatagagccttggccgcggcttattcttcagttcatattctctggaacctgaaagcaaaggtgttgctcctagagaaggtctcagccaaacatgagaaagtgtgagcagtaacaccagggagacccatggaaggaggattgcatgcagctccaggctgccctcaggctcatgggccctgcagcgggcaactgggtcctcacccacccaccaaggcagggcctagtgcctcatgggccagctctccctggaggccccggctggaaaagaggctcccacagagctgcagctgcagcagtggcgtccaagaccatgtttgaagatgaaatcattagaaacccacatacgctggcacacccttcctccagggctgtcttgtcactgtgttttaaggctatgttatgtccataccaacagtctatcttggcaggacatttgaggacaagcattctgaagactcagtcgactgtggaaaactgctctcttcctctgcacgcctcccgagtcctgcctgtgatgggtcttaagtgttcctcgacatcgttttcacagttgcctctctccctcctgccacagggaggacgcctgataggtgctggcagactggatccaggccaggtgtctctgccagggacagggaggagtggggaaagacagcagcaatgatgactttgatagtgggtgaaaatcaatcacaggtgaccatcacatacacatctcctgagtacccccatccaggaggagcttcgcccaaggtctcatggctagtcagcccatctgactcctaaggccacagtctggtaccctgctgcctgctccctggggcccgagggattcagatgctaatggggacacaggggccacttggtgtctgtccctatctcccacagagtctgagtgatcaaccttaatctaacaaaaggattaggtccctttaggaatatccaaaatggcccagacattgtcccatttatgtaggatagcctggtcccctgcccctgggagccatagttctggctgccacatcacaaaagagaaggaagaacccggggaatggccagagaggggaaactaaacaaccaagggtggatgggagtgaccccatcaggaaagaatggagagatgaggcaggaaggtatgggtggtgttgggggaacggaaggagggaggcgagcacaggtggggtggggtggggtcggggagaccataagagggccctgtgctaggcactctctcccctcctttcaaactctgcctcacaagcctccagtaccccttccacagattcaaaaactgagcctcaatgggattaggtaactgttccaagaccccacaaaaatgataaatggaaggagccaaaaagtcaaaatttggtctgatcattaagtctcctcttttgaccaggctctacagcctaacaaaatccctcaaatacagcagtctgtagaaaggacacagccacctggtccccacagatgccactgatgctcaggtcagaatcctgtgccagtgatgcaggaggcatttctagggtttcagcaacaggtgtttccagtggagaaagaaaaagggaaaaaaaaaaacaaaaaactcagaagaggacagagcatatgcaataggaatctaccaaacagagttgcttctgtagccagatgcctccttgggttacctggaacctttgcatggccagtcaaggagggaggcctttggaaccaggcataaaacattttcctgggaatggggagttttggctgagtcccatggactggggtaacggacagagagcgcctcagcaaggcacccgtgcagctgtgcaggactcgccaacagggtgctccagagctcacctgctccaagaattcacttggggttcagagtccacaagagaggcctttgtgcacaagcacagttgctctgccttttgcctgtgtcttctctccccatgttgagctgagaggtgtagggcatcatctctggggcttgagggctgcagggttgagtttctgacacctgactgaagcacctgaaggcagaaactggcgagctcagggttcacagggctgtggtgggctgtacaggccaggacatggggccgtaggggatgtaaggccaggatgctgcgagctgcccgaggtccaggcatggattcagggaggaggccccaagcgggctggcttcaggactcatctatggtggggaccacacagaagaccagcccctgaggccagggctgagggtggacacgagtagtcagtgagaggagccaccactgcagcccagggacctaaggacacagcccctcaactggcagagagctctgaagacccaaaaaaagcacttcctcagacagcaggtcagcactgggacctccagcgagcccagcgggccctgaaggaagacagcaagaaagactttgccaccctcctgcccctcctccctgcctgtgccggccccacaggggacacagacagcagccagagaaggggaggaggcaaaaggtgaaacagagaagccagctggaagctaacccagtctttcaggaggctcaagcttggggctgatagccccctgcacaggaaagtaaccagaagaaccacacaaaatttccagggtgccacccgggaataggaaagagcaagtcaagggagagtttgcaggcatgatggcgagaagaactaaggtggctttattcatcccagcctgggtttcccagaacctgttccccacggatgagggtaaagggtgcagtgcgggccctgcatcctgctctgggagcccctggtatggagacagatggggcagcccctgtactattggtccttgacacagatgatggcctggagtcattttaaacttgttactttcccagaaagcaactatgtcacgtatctgaagaggtcagcagggaccagagaccaggtgtgggtgtgagctagacctgcttcctctcactgtgcctcccaggaggactcacagtggccaggccccggccacgtggaagaaccaggccttccctagggcttggggagggattagtgaggtcagatgggaatgtgaacagtgtcatctactgagcccatgttatgtgtcaggcaggcctatgagctgtcattatcatcaccaatcacagagaaggaggctgagattcagagaattagataatgtattagggttctccagagaaacagaaccaataaaagacatacatataaagagatctaatgtaggtattggctcacgtgattatggtgtctgagaattcccacgatctggcatgtgccagctggagacccaggaaagccagtggtgtaacacgaaggcccaagagctggagaactgatggtgtggatccagtctgaatctgaaggcctgagaaccaggagtgctgagggcagaaagtccatgtcccagctcaaacaggtttggttattccgccctccgccactgttttgttcccatcatgaatagatcagatgagccccacccatattggtgaaagccctctgctttctgctctccagcaattcaaatgctaatctcacccaaaatgccctcacagacacatgcagaaataacgtttaaccagctatctaaccatcacaggttagcttccaatgtcccacagcctgaaagacacaaagccagaacctgaacttagaactgaccaaagaaacctaagcccacactcttgacaaatgcagaccaggcatgaggagtaggaatcaacaacttatcttgactatggtgaaaataatcatttttgttctttaaacttttaaaagaactacttatttgttttctgtttgatgagaagggctaagtggaagctgagaggccagtccgacagacaaagaggagaagagagcagagcaagagggaccgtttgggggaccctctggcagcccccgggggcatcttctgtctaggtccttacttttctcacatgctaacctctctgctttctctttgtagttgagtttctgaaatttcactgacaatgtgtttgctgcatttctttttattagcttttttcggaagtagctagaatcccaagtgatttcctagcacacagtctgagagttgtcaatttcagtcagtcttttgaggaaaagcaagaggcattttattcctgggagatgcccacaccacagcctggtgctcccgggccatgggctggccttgtgaaggaaaggaggcattcttatgtgtattcctgaaggtgccatgacttccaccagcagaccaagcagaaagagcatctgctaacgtaaggtgtcctcactttgcagatgtgggacccggctcaaatttttaaagacatttctaattgaaaataagaccaaagttgactatctagggatggttctcaagtaggagccttctctgatcttcctgtctaaagaatccaccttttatcactctactgagagttttttattattttattatttatttaaatatgtttaggggatacaagtgcaggtttcttacatgcaaatattgcattgtggtaaagtctgggattttagcgtacccattacccaagtagtgaacattgtaatttttcagtcctcacccccgcgaaccctccggcctgtcatagcttccagtgtctgttattccattctgcctgtccatatgtacgcgttgtttagcccccagctataagtgagaacatgcagtatttgactttctgtttctgagttatatcactgaggataatcgcttccatatccatccatgttgctgcaaaagacaggattccattcttttttatggctgagtcatattccatggtatatatatacattttctttatctaatcctacgttgatggacacttaggtggtttctatctttttgccattgtgaatagtgttagagtaaacatgcaggtatctttttgatagaatgattcatttccctttgggtatatacctagtagtgggattgctggattgagtggtagttctatttttagttctttgagaaatctccacactgttttccataaaggttgtatgaatttacattcctaccaacagcatgtgttcccttttcattatatcctcaccaacatctatttttgtttttgttacatttgcttttgaagacttggtcataaattatttgcataggccaatgtccaaaagagttttacataggtttccttgtagaatgtttatagtttcaggtcttacatttaggtctttaatccattttgagttaatttttatatatggtgagaagtgtgggtccaatctcattcttctgcatatcgctatgcaattttcccaacactaaatagtgaatgacgcaaaatgaatagtgtcatttccccagtgtatatttttgttggtgttgttgaagatcagttggttataagtatgtggcttcatttataggttatgtattctgttccattgatctatgtgtctgtttttgtaccaataccatactgttttgtttactataaccttgtagtacaatttgaaattagatgatgttatccttcagctttgttctttttgcttaggattccgttggctagacaggctcctttttagttccatatgaaatttattgttttttataatcctgtgaaaaatgacattggtaacttgatagggattgtattgaatctgtagattactgtagcaatatagtcattttaatgatgttgattcttggaatccatgagcatgggatgtttttccattcatttgtgtcattgacaatttttttcttcagcattttgtagtcctccttatagagatctttcacatccctggttaaatatattcctcgatatttttgtagctaatttaaatgggattgccttcttgatttagtcctcagctagattgttactggtatatagaaatgctactgctttcattatgttaatgttgtatcctgaaactttactaaatttgtgtatcaaatataacaggtttttggtagagtctttatggttttctaattataaaatcatatcactagcaaacagggatgatctgactccttcttttccaatttggatgccttttgtttttttctcttgcctgactgcgctgtgggtacttccagtactatgttgaataacagtggtaaaagtgggcatcctcatcttgttccagtccttagaggaaaagctttcaacttttccccattaagtatgctgttagctgtgggtttgtcatagaagacctttattatgttgaggtatgttctttctatgcctagtttgttgaggattttcatcatgaagtgatgctgaattgtattgaatgcagaaatccttgacaaaatactagcaaatcaaatctaacaggacatcgaaaagataatacaccataatcaggtgggatttatcccaggaatgcaaggatgattcaacatacacaaatcaatgaatgtgatatatcacgtaaacagaattaagaacaaaaaccatatgatcatcttgatagatgcagaaaaataactgataatttcttatttgatcatgtgttagtatctctccctacctaaacctgcattcatgggcacacatgggcaagtgtgagtgcgcgtgcgtgcacacacacacacacacacacacagcacagtgctagacctgtagtggataatcagtaactatttgtcacatgactgacctcagcttattgatcctaagcaataagtcttgttcctcaagccacactggccactgctagaaggtctttcagagcctaagatccattcagtcccttcgaagcactgggaggcccccgtccttccatctcagcttcccaggccatagctcttagcagagtccctgctagcctgtactgtgcctttggagagtcttttgtaaaaggtgcctgtctgggcaggcacagtccttgaccaggggcaaaggcccacagcaggacataggctgggttcagccccttgagcctcctcagactggctctgctgtgcagggccctacctgagagaggggttgaggcacacctctcagaaatgctgcccatgagatctgtgcatgaggagaaccttgcacctgtgaaaaggagtaaggaccatccccacctactgtgctgtgggtgtctcaggatgcatcaggaggaggaaaaggcagtggttggactagtgagtataaacatgctacctagaggtgggaggatgtgtgcatacagtttatgcgcatttactcacattcatacgtgtgtgcacacagatgtgcacttactttttttttttaatcagatggagtctcgctctgtcacccaggctagaatgcagtggtgcgatctcggctcactgcaacctccacctcctgggttcaagcgatgatcctgcctcagcctcccgagtagctgggactacaggcacaagccaccaatgcctggctaatttttgtatttttagtagagacagggtttcaccatgttggccaggatggtctcgatctcctgacctcatgatccacccgcctcggcctcccaaagtgctgggattacaggtgtgaaccaccacacctggccttgcacttactttttttatggaagggtacaccaaaaaccaacacctatgtccccataggtgaggtgactacaatttatcatccaaactggttcatttgggggaaggaaagtgggcactaaccacttgggatgtgtgaacaggactttcccaagcaaaacaggaggtgtggacaccccatctggaggaggggatatggggagggacctgggaggcttcatccaggctctccgtctgggtggctgggtgactgccctttaacaagacctgccggccccagactggcttccttatctatgacacgcgctcttgccgaggatggtctccaaggatggtggctacagcttaagccagggtgcccccaaactgttccctggggcctgagataccatctggaccttgctccatgacctttgcttcttggtcctgccaggagggactcctcagcctctgcccacccccatctttctcagggtgttttcattgggtagacggtatatccctaaccctggaaattctccctcctcaagtacccactggagaagcagatgtaggtgccctggagaactcagtgtgtggggcccaaagcatgttaggaagttctcaggacatgcacatcttggaggatgaagtcattatattgcatgtcagtcttctttgcagtaagcactgatttttaagcattttaggaattgttatgtctttgcccagtggccagattctccccacaatcccagatctcgcatttgctcagcaaactcacaagaagaagacatgaagtctcagggctaaaagtgggagtgaattttcagaattggtttttctgaaactgatttctaccaatgggctctggtcacagagtgcaggtcacagttccaaactctcgtcccagataagatcttgtttgcccttcattttagagcccccagctaaattggagttccagtaccagagcagctagaaaacctgcaataaggagaaatgaaaagggacctggacataggcgtttacagtgtgcctttcatgggatacttctcttacctggcaggtgtcctaatgcctggttgcctaacccatgacccatgtccctcacatgggaagcttgtttgtactggcagatggctttgtggctcctgtctggcctgtgtctagttttttcttacctgaccatcgctctgtggctgggaccagccttgtgttctccttggcgtctggtgaaaacatggcctggggtagcctctgcttcttccaaaggaaggtgcaaattcaatccaccgccacaatgggaagcaagttcaaaggtttttacttatagatcctgggcatggaggccatcatgagttgggagggcagtgctccatcccagggtcacattgaggcagggattaagattcaggcagagagatccaactagaaatatatataggggaataggatgtgggtcactttaagttcatgggcaaatgtctgaatggtccatttaaaggaagtggtgggaaagtggaaagcccagtctgctaggcagagagtcgcctctaagttcttatctctggccaccagcttgggtctttgggtgtggtgttctacttctaatgcccaggcagcaacctctgctgttttgtttctgttacaccctctacaccctcaggtgctctctggctgccttcaacactgaggctcctggtatagaaccaggaccctccctaagtcttggacaaggagccagaagcaagtagggaacatcattatgattttcaggctgccccccgctggagctgggatcctctccgccaccccctgggtcactgagcaggtttcagttgctcacatggctcccatgctcaacaccaaaactggaatggagaaaggctgctctgctccagctgtcctccatcacctctcaactgggcccgccatcctatcattgctgctgaaataaaatggccctgccttaagttagccatgaaaagaatgccatgccagtacaatggtgcctaatacttaacctttgcaccgttgttaccttggaggccctcttgcatagctactcaaataccagagtgttctgccaggaggctccatgctgggcatggtccaactccatgcctttgccctagcacagaacttgaaggacgggtagatgaatggacagacaagtaggtgcttgggcagatagatggttgaatggaagaattgaaggatgagtacatggatggatgcgtgcgtaggtgggtgggtggatggatggatggatggatggatagaggtacatgtgggtggatggacaggtggatgggtgggtgggtggacaggtgtatgggtgggtggatggcatggatggatgaatggatggacagatggatggatggatggatagatggacatgtgggtggatggacaggtggatgggtggttgggtggacagttgtgtgggtgggtgggtggatggcatgaatggatggacagatggatgcacagacagcagatggatggatggatggatggacaagtggatgggtggatcaatagatggatggatgaagagagagagggagggaaggaagagagatgggtgggtgggtgggtagatggatagatggatgaatggatggatagatagataggaagaaggatggataggttggtagatgttacatgaaggcagagttctctgagggcctctgcagtgcctttcacagcaccagtgtatagtaagtgctcaatgaatatttattggttttttggttggaaatatgatggccctgctttaagttttgcatgaggagaatgctgtgccagtacaaaggtgcccaatactgagccttcacgctgttgttaccatgggggtcctcctgtgtagctgctcagatcccagagtgttctgccaggaagtgaagatgggactcagaacccaggcctgagagggctaccattcaccttgctctgcccgcttctcagtattagtacctgactcaagagcagctcctctctttccagcactgccccctccattccttgaattagggaaggaacagtgctccacatttctagctggggtatttctctctccaagtatgcaggttttaactccatattctctccccctgtgctgttcattatgttgttcaaccattcactcgccggcactcaacgcatactaggtgacagggacaaacaagcaacttccaaaagcacttgaccccccaggcactgcagcttggctttcaggtgtggctgggcaggctaatcacctgcagtgtttcaaaatgcacacccaggagcactgcatttagacctggcataaaatatatgtgtgtgtatgtgtgaatatgtattcatgtcaatacatatttaaaacattcctcttctacttccctttccttccttgctgaaaaagtaagttctaaagccattaggtggggcaaagcaaggtggcatctggagtgggtgggggatgggaggacaccaggggccagagccagatgtcagccacacaggtgaagagggccacctcacggatggggagcagaggtgggagatggctgacatatgggaagactgatcaaataaggaaatgctttagaatgaatacgaacaagttttctgaaagtaagtgaagaaagttgcaaatagaattaactttgtggggttggattggaattggaggtatcagtgaactcaaggttttctataaatattgagagggagagaaagatgaaaataaacatggagagggagagaaagatgaaaataaacatgcaaaaatatgtatccatgtgtgagtgtgaacttgaaccatctttttgcaccaggaagcaagaaagtgctctaagaaatgatgggagctgggcacggtggctcacacctgtaatcccagcactttgggaggctgagacagaaggatgacttgtgcccagaagttcgagaccagccttggcaacatagcgagaccccgtctctacaaaaatgaaaaaagttttctgggcataatggtggcctgtggtcccagctacttgggaggtcagaatgggaggctcacttgaccccaggagttcgaggctgcagtgagctatgatctcaccactgcactccagcctgggcaacacagtaagaccctgtctcaaaaaaaaaaaaaagaaagaaagaaagaaagaaaagaaaaaaagaaatgatgaggatgtcaaaaggacacagatccagctttagagaagccacactgaccacatcaaggagtatctgagcatccacataatcacactaatggattataacccactgaataaaatggaaaaccagaaatccatagtgataccaataaacctataaagatttggtgaggaatggagtatttgcataggttcaagttcctctccacaaaatgcttgttaatttcaaacgaaaaattagtagtctgcaggggcaaggcctggaagatgaccttaaggagtggtccaggtcaacctcaccagtgatgggacaacctcaccagtgatgggacaatctgcagttcacacaacctgataagatgtcacaagaaggactcagcttgacccaatccaatctaactgtgaggaaacagagaaacccttatgaaggacattctacaaaatacccaacctgtaatcttcaaaaatgtcaaggtcatggaagtcaaggatatcctgagaaatgttccaggtgaaggagactaaggagacgccaccgctgaatgcagcacctgatcctgagcaggaacctttgttctaaaaggcattattgggacagctggcacacacacgtggggtctggtgattgcatgtaactgtgtgaattcctgatgtcggtagccgtgtggtggttgtgtaggaggatgttctgttcatagaaaatgagcaagaactttccagggtgatggggtgccaggttggctgtttattttcaaatggttcagggaaacaaaagctctttttactgtatgtgcgcaactattttgtgaggtttcgattgctgccaattttttgaactgttaaaataaggttaattgggttggatgtggtggctcatgcctgtaatcccagcactttgggaggccaaggctggtggatcacttgaggccaggagttcgagaccagcctggccaacatggtgaaaacccgtctccactaaaaatacaaaaaaattagctgggcatggtggcaaatgcctgtaatcccagctacttgggaggctgaggcttgtaaaaagtaaaatagaggttcttctttaaagactttcctccccatctagttaaaaataaatagtaacttcttttagaagcaaaatttattcaaagacctgtgctaacattcttaaatatctgctagccataataaaaaaatcaacatactttatattcttagctcccacaatttaacctaaatatttgccttgcatacttatactagtccaagcaagcactaagtcatagtctggtcctcttccttctttaaaagcatttttacctttctcaacattccacaagttacttcctccttcctttattctcctctgcatttgcctcttttaaaaaattctaagttactaaccaatcaaaacaaatacaaaatgtaaaatcccgttccagccaataaaaaccagacacatcagtaaggtggacacgtcaggttataaatgaccctgtctcctttattcaatatactctcataacaaaactgctggcaagtacaccctttctacagaaaataaaaaatggcctcgctaaaaaaaattaaatttatattcaagtaatattgctttacgacaccaggaaacaaacatttcaaacaattttggtgacccgtatggggatacattctctgccgggggtggtctccagtccctcctcataagggagcgtgctcctctgccacattgcagtggcctcaaggataagagctcaaaacccacccggtatgtggaataaactcagagtctcagcaatgcaaaaaaaaaacaattcctcacatatcacgtgaaccagaaaactgtgcacagattgaggaaaaaacaccaggaaaaaacaccggtaaagtatttccttagtaatcaagactgaggaaaaagctgcggggcagtaaagcattccttagttaaaacataccaaggagagagaaactgcaggggcagtaaaacattccttaggactagacacaaaaagccatgggaggtggtaaaatatttcttagccaggatgtcttaaaggttaaaaaaaggtaaaaaaaatccccactgagtgggggttaaacctcaaaaagaggtgagaaatccccatgggcgggggggttaagcctcaaggtaaaaaatccccattgtcgggggttaaacctcaaaaagaggtgagaaatccccatgggggaggagttgaacctcacacaaacctccgatagtaaaatatatatacatatatatgtatgttacatatagatatacatatatatgtgtgttacatatagatatacatatatatgtgtgttacatatagatatacatatatgtgtgtgttacatatagatatacatatatgtgtgtgttacatatagatatacatatatgtgtgtgttacatatagatatacatatatgtgtgtgttacatatagatatacatatatgtgtgtgttacatatagatatacatatatgtgtgtgttacatatagatatacatatatgtgtgtgttacatatagatatacatatatgtgtgtgttacatatagatatacatatatgtgtgtgttacatatagatatacatatatgtgtgtgttacatatagatatacatatatatgtgttacatatagatatacatatatatgtgtgttacatatagatatacatatatatgtgtgttacatatagatatacatatatatgtgtgttacatatagatatacatatgtatgtgtgttacatatagatatacatatgtatgtgtgttacatatagatatacatatgtatgtgtgttacatatagatatacatatgtgtgttacatatagatatacatatgtatgttacatatagatatacatatgtatgttacatatagatatacatatgtatgttacatatagatatacatatgtatgttacatatagatatacatatatatgtatgttacatatagatatacatgtatgttacatatagatatacatgtatgttacatatagatatacatatgttacatatagatatacatatgttacatatagatatacatatatgttacatatagatatacatatatgttacatatagatatacatatatgttacatatagatatacatatatgttacatatagatatacatatatgttacatatagatatacatatgtatgttacatatagatatacatatgtatgttacatatagatatacatatgtatgttacatatagatatacatatgtatgttacatatagatatacatatgtatgttacatatagatatacatatgtatgttacatatagatatacatatgtatgttacatatagatatacatatgtatgttacatatagatatacatatgtatgttacatatagatatacatatgtatgttacatatagatatacatatgtatgttacatatagatatacatatgtatgttacatatagatatacatatgtatgttacatatagatatacatatatatgtatgttacatatagatatacatacatatatatattcaaaactcccctttcccctcttcttgggggaaaaaaaaaagactaagctccactcctgccagtcgctcctctaggggaaggggaaaaaaaaaagcaaaaacaccaagcatgacgccagacagccaggcacaccaaaaattaagtccctctccccacccgagctctgtgtgaaaaagagagcggggactgtcgcagaaagaaaagccaacaagatgaaaggacctaactcttacgactaacgacaggtgtctgccaagcctgtgggccagtgatggccctgggccaggactgcagccggccgggggccaagactacagccatgcaaatcccacccagcccagaaaactaagtgtagaaaaaataaataaatcagggaaaaaaaaaaaaaacaggggaaacagacggcagcgcatacatgcaggcggggcccgtcccttgcccagcctgcgccgcaagaccgggaaaaaaaaaggaaacaaaaaatgacagagagggagagaaaaataaatgcaaattaaaaaaaaaggaaaataaagtgcaaataagaaaaaaaaatagaaaaaagtaaaaaaataactagaaaagacaaaaatcaaagaaagacacggtaaaattaggaaaagaaataatgtaaaaggcagaacgttaaaacatgttaaaaattgtctataaaagtcataaaaagttataaaaaaaatttatgcaaaaaatattacgtaatttaaaagtaattaggcctcctaaatgtaaaactatttaaaaaacagtttatacagtttatatacaaaatatgtaaaaatatatacttttaataaaattacaaaaagacataaaaatatgaatttttacctacattaaaaggttaaaaaaattttgttttaaaactttaaacaaggctgggcgtggtggctcatgcctataatttcagcactttgggaggccaaggcaggcggtcacgaggtcaggagatcaagaccatcctggctaacatggtgaaaccccatctctactaaaaatacaaaaaaaatagccgggcatggaggcaggcacctgtagtcccagctactcgggaggctgaggcaaaagaatggcgtgaacccaggaggtggaatttgcggtgagctgagatcgcaccactgcactccagcctgggcaacagagcaagactccgtctccaaaaaaaaaagtttaaacaaatttaaaaatattaattataaagaaaattctgtatgtaaacatattagctaaagaggtatccaatttttctgtaaactaaacattaaaataaaagcacaataaatttttcttaaagcactaacctgctctttaagaaaaattataaaaagttttaaaaagtctataaaaaccttaccttatagtcagacattaaaagtaaataatgtcttcaaaattttattaaaataaagtttaacattaatagcacattaatgttaaaaaacataaaatcatacaaaaagcattatcaaatataaaatagtgcttaactttctcaaagcccgagggcggccgaataagtcacaaggcccctcatccccaaggccacaacgcgcaggggcggtgaaggccacaaaaaagccaagaccttaagagggggcagggccacaatgtcccctaggcaacgctaagcagaaatggagcagaagacgtcaccatggggcctcaagccccagaatacgcaacaaaaattatatacgtaatttatcttccactttccctttcctcaaaactaaaaatcttttaacacaggtaccaaccctaaaatttctagtacatcagcaccagcctacaaaccacattcttgcctggcgcagtgcctcacgcctgtaatcccagcactttgagaggctgaggcaggcggatcatgaggtcaggagatcaagaccatcctggctaacacagtgaaaccccgtctctactaaaaatacaaaaagaaattagccgagcgtggtggcgggcgcctgtagtcccagctactggggaggctgaggcgggagaatggtgtgaacccaggaggcggagcttgcagtgagcggagatcggcgccactgcactccagcctgggtgacagagcaagactccgtctcaaaacaaaacaaaaacacatccttatcaaaaaataaaaaactcaagccagcctgggaaggaccctattttatgctgttaaccactaagacccctgtccacacagccaagaaaaaaaggacccactatactcaaatcaagaaaacatcttaggttactatactaaaatcaagccctactaagttaaaattttaaaaagcttaattttcatatactttctctattacttcctttcctttccttattctgttatagctcccttgttattaatgtaactaaatctaactcacctcaaaccattgcctttaatgcttgctctatcataccttgtaaaaatattaaaaaatcaatgacagctagccttttcacacaaatatttatgtcctggccctctaattaacacaattacccctaacacttattgttataatcacctgcagccaaaacgccaattttctgctcctactgagaggtgaagccagctggacttcctgggttgagtggggacttggagaacttttctgtcttacaagaggattgtaaaatgcaccaatcagcactctgtagctaggactgtaaaacacaccaatcagtgctctgtaaaacgcaccaatcagcagaatcctaaaagtagccagtgacagggaagattgaaaaaaggacattctgataggacagaaatggaacatgggaggggccaataagggaataaaagcttgccacccccgccccccagccagcagcggcagcaacctgctcgggtcctgttccatggtttagaacctttgttctttctctctccacaataaatcttgctgctgctcactctttgggtccgtgccacacttaagaggtgtaacacgcgacttcattcttgaagtcagtgagaccacaaagccactggaaggaaccaactccggatacactacagcctaacaaccttataataaatggaacgacgtcctttaaattactcaagagcaaagttaaacttccacacacacacaaaaaaaacatacagatctaaaacccttcatctatttcattaaaaaacctacccaaccttctcaatataaccctgtccttctgtcaccacctccaccttaactaactctaaacctacccttaatcacttctataatatagaaatttgacataaatttttaaaaaccctaaatatttttaaaatacacattattcccccatcttccccttcttcagtagcctaagttctaaatccgacaccagttactcctgcatctaataaaagtagaatgcctattataaaaataaaaaattaaagacagaccttagccatcaaaacaatacatcaaaatacaaatgcctagctaaaatattccattcacactttaaaaacaattattacactattacatttgtacacatggtactccagaggcccaaattatcccctttccacttaaatggtcacctcatcaaccaaatataaactatatagtagctctttttcaaaatcccactgcttaaaataatccatcatgccaagctctctctgctatttcctaaaatttaacactgtgcgggtcagcccctgaggacaatccagcttgcaccttttctaaatgccaaacttacactgtgcctctcatggcaagaaaaaaatttaatattccttaaaagcatttaaaaaatgctttttccaaaagctcgcccatcaatccatgcttagccatccccaagcaaatatatggtagtactgtaaaggacctttactaaacgctgtgccaaatatttgaaacagtactaatccagttagctgtccttcactctagcatttcatcaatctaaaaaaataaaaacaaaacaccgcaggccaaaaaaaattccttgtaagtcctttaatcctcaagtttatataaatgctattaaaatcctgtaaaaaaaatttcaaataaatttaaaatacaaaatcaaatagctgcaaaatttaagtccacgttattctggtaagtatgaatttaaaaaatgtaaactaaactgtatctgttacaatcagcaacaattcataaattacactgaaaacgccatcaaaaaaatagctaagcaattaggacctaccagacaaattgccttaaaaaaagctttaaatataatatcagcaaaaaaaaaaagtcataattaaaactcaatattgtacctttattcctaatactgcccctaacaaaactataacaaaagcactacaaaaattaacagcactatccaataaacttgccaaaaattctaaaataaataaccctttttctaaaataataaaacattaattcgataagtaaaaaaaaaaattgtggccaggcatggtggctcacgtctgtaatcccagcactttgggaggccgaggcaggtggatcacgaggtcaggagatcaagaccatcctggctaacacgtctctactaaaaatacaaaaaattagccgggcgtggtggcgggcgcctgtagtcccagctaccagggaggctgaggcaggagaatggcgtgaacccgggaggtggagcttgcagtgagccgagatcatgccactgcactccagcctgggcgacagagtgagactccacctcaaaaaaaaaaaaaaaaaaattaacttcaattctcaccttgttcgctcttattaatatacttataagctattatgttattccctgccttcaaaattttatacaaaaacttatctctaccactcttacaaagttaactcctaactctcctccaccctattcgaaaaattacttctcttaaagctattaaaacagacaaattaaaaaaaaattataagagggagaattgtaaaaagtaaaatagagttttctcttcaaagcctttcctccccatctaattaaaaataaatagtaacttctcttagaagcaaaatttattcaaagacctgtgctaagattcttaaatatctgctagccataataaaaaaatcagtatactttatattcttagctcccacaatttagcctaaatatttgccctagcatacttatactagtccaagaaagcagtaagtcacatcctgttcctcttccttatttaaaagtatttttacctttctcaacattccttcctttattctcctctgcgtttgcctcttttaaaaaattcaaagttactaaccaatcaaaacaaatacaaaatgtaaaatcccattccacccaataaaaactggacacagcaataaggtggacatgtcaggttataaataaccttatctcctttattcaatatactctcataacaaaactgcgagcaagtataccctttctacaaaaaatataaaaatagccttactaaaaaaatttatattcaagtgctatttctttacaccaccagaaaacaaacatttcaagcaggttgcattgagctgagataacgccactgcactccaggctgggtaacaaagcaagactctgtctcaaaaaaaaaaaggtaaattgagtcataagaaaaagaaaaaacatgggtagtatgtaaccaaaattccacaggtgatggtaatgcattccctaggattcacaccctgcattctggaagtcccaggtggctgggaactgtgcccatgaacccatgaagctctttccccaggccatgccaggggccacatttgccagccctggccccacctgctgccgtcagctaattctgagcattcctcaaacactcaggaacaagtctgagagccacctctggggagtcttggctggtgctgtcatctcagctggcaggcactgcaggtgcagccgaggctccataacgctgtgagctctggctgtcctctcaacgtgcacctcccttttgggtggccttgctatggggggacatcgaggctgccaccttctgcccgaacgtcttagggtttgagtggaagcattcttgagcctgcggtttccctgatcctcagacgtgagcctgggcatggtcagggagggtctgggccacctgggctgcacattcacatcgcatcccctccagctctggattgaaatccagacagccttctcactgttctcctccattggggtgagtgtcttctagaaggctcctcagatcttggtggtaatgaccccaccagcccatcagatgtgcccagggaacccctgggtccctgagagaaataaacaggagaggaacccctccatccctctggcccccactgcttccttgtgaaacacccccagaaagccaatagccctgctaccacaggctctggtgggctgcctccgcctgcagagagactcgccttcacagcggccggcacccttcacctgcgggctctttccaactcatcttctgagaccgctcccacggtggggtaggggagctgggacctgtgcatttgccatcggcggatggcatgagaagtggcccaggatggcgcagctgccggggtccatgaagataatatccagagtggggagggctcagcccctgcatgaagcagtccccactttctccatcctccaccctgttttagtcagtgaccagctggctctgttttgtttcacagtgtggacaactctgaggaccccgtgtacgagagcctggaagagttccacgtttttgtcctagcccatatattaagaaggcccatcgttgttgtggcagatacaatgttaagagactcaggtggagaaggtaagttcctcaaagagatgtgttgtattcatgacacagaaagcatagcatcccagctagaaagcagatagcacagcacaaggtcgagctcccagaggccacaaagcatcactctgtgcaaagatctcctcgacgtgtttctttctcctccctgatggcagcagagattgttcttgactagctgccctgcctatcaacggcaggtggccaggagaaatctggtcatgtgaggaccaggaccaagcccagaggggctcctgtctcctgtcgtgtgcctagggcatagcagacagcccacacccctccaacagccctgggccatgtcctggaggcactcagtcactcaggtgtgttcccacccctccgcagaccacatgtgtgttaaagactaaaaagaaaggaagacagaatgcatagagtcatttggcaaaagctatggtagaatcagaactggcagagaaagaggcaagggcagtttatggcctgcccaccaaaagccacactctgtgcacagccccttctagaatgttcctccattcagcccttgctacaacctcccagggtggacaccaccctccccactttacagagatgaaactgaagcccagagaggctaggcaatgtccccagcggggatcagccaagggcagggagtgatccaaagcctgtcctccctccagcgtgcagctgcccagtttgaatttacacctgcaccttaacaaaagtcataggtcttccagggagctctacgaatcaggatgtggctcttcacgctaaatcacagctgccataaaaaatctgatgtggccacgatggttatgtagccagggaactggtaggacacaggtcctgcctggcccacccccttccctgtgtggctcagggacgcgggcctgctgaggtctgcaggtctccgtgcaacaccagggcttgcatcagggcactgctgcgtaagcccaggactgagctcccagcaccatcagatctctgagttgcggggcagaggaaggtccacgcttcctaccatgctactcacagccctcttgcaggtacccccaccctgtcgcctctcagtctgactctcctgtgagcacagtgatcaatttagacaaagtgaggatggcggaggaactcataagagttcatcaaagacatccctgaaattaccgtccctgaattctgctcaaggagtgcagcaatacactcactctagggccaaaagtaaagacgtttcatgacctcaaagcagatgctgctttaggacagatatttccagaagttattctattttgctgagggtgttaggcttttctgccctctttttttacaagtaagaaaatgagtgaaattgtgtccctgtcactgaaggacttgatccctctgattctcagttcccatctgacttacatcttggtcctggagctctctgactggttccttcaaattcaatagaagaggttctcaaaacatagagcaaatatacacccttgagaagcgcacatactctgttgtatacaaatgctttaccaaacactaggaaaggaagaagtacatccagaaaaaggtgggcttccaggctgcaactgctctgaccaatctcgggtgactgtcatcccagccctggggctcctgtacacctgtgcaggtctcagggcagcaggagtcctggggcagacagatgactctggaaaccctcagccccatccctcagcaccgcctccatccacccctcctgtccctccgcttctccacggagtccccccggggtagtgagggacagggatgcaggggcctcccctcccagctcgagctggctgctcctcacaccctcaccctggtttgtgtccacagcgttcgcacccatcccattcggagggatctacctgcccttggaggtccctcccaacagatgccactgctcgcctctggttctggcctatgatcaagcccatttctctgcccttgtgtccatggaacagagagaccagcaaagagaacaaggtatgcctgtctcccaagagagtgcacgcaggagcctagggtgggggcagagccatcagaagggaccccattgcacggggaggtggattgtggagacccccccttagaagcacacctgtgcacactcagcagtgacagtttttgcataaagctaccttatgcatgtgtgaacgttttcattgaaaataacaatgttaaagacaacattctctttaaaatactaaacaaaggcaacctacccttaaatagcttttactgttttccctttcacatgtatacatattttataggaatgcaattagtcttagatataaattaaagggaaaaaaacttcaaaagcaagtattaatgaactatggcccaccacccattttataaataaagttttattggaacagagccacattcattcacagatgcatcatctgtggccgtttttgcactacagtggtagagagaggagcagccacagacaccaaggcctgcagcgcctaaaatatttacttactaattagctatttatgggaagagtttgctcacccctgctccagggtaagcttttaactcaaaaggtcaacatttcctttcaaagcattgcagctgagtttcctctaagcagccatttcagtgctgctgatgttgggccagcccacaggctgtgcactgcacaattccagggcaccagtcaatgtctttactggggaaatagggggattttgtttggaacaattgctgttttctcatgttagctactgatggatgtgtgaccagctgagtggagaggaaaccccttcctgttgtcattcttgtttgtagtataggcagagactcactcccccaggggacagacggacaggcaagaccaactatttcagagtccctgccattaggtatggtcccagagaatgggaagtgccctgtccagggccaacagggggaaggaagctcaggggtgtctgcttctgaccttttccactgagtgtgcagctcaggaagtaaatatagcaacaagattgcacccctaggactcccaaatgctactccttcctgtagacagctgggaaggaaaggacacagacaaatgaacagaacccagcctcccccagccctccgccagaggcggcaccagcgtgtcacttcctggcctggcagttgagtcgggaatgaggctggggctgtggagcagaagctgaaggtgagaaatgcacagggcatttgagaccccttcccaagagcagatgcagagctcccaggagctgacatgcgtggtgcagccgcagaacccaagtcacaggaagagagacgactggaggctacagccggccgtgacaagaatgtcacatcatggttctttattatttgcagatgtggcactggccacagaaggaaagatttaatcagtaaggcctcggaggtgctccggtctttccattgtctccccactttcaatccggaatgcggaatgcctgcacctccttcccggggatttagctcttcgtagggctgaccccgcctcttgggagaccagaagggccttttcaggacctgggatcggccaggggcggggccctctgtccagtccccagggagattctgtggtcagaaggtgatggtcccaaggccagcgtctcccagttccgagcatggggttcagatacccgaccccctcctcgcaaaaggcaccgagtactcttccaggccttccagatactgctgcttggtgttttcaaggcacatatgaaagcatcctcccttcaaaggatgcccatggagggcgctgtggcttgggacctttcaggagggccttgcagagttgtgggtggtttcacttctgatgacctggtttctaaaaactgggatctggtcccagtgcacctctcagagccactgtggtgtgggtctttggctccctcacagtcaaagcagcccactgggatcctcctggggcgatgcaggtccctgcctctaagaccatcctgtggccaggctgcacattcacccataaggtccccacgacccactgcagggcaggtgccatggccacgctctttgtcacctgcacccttgtgcccccttagaccttcacctctgcagccttccctctgtgcctcaaaggacactgtggggacgggacagagtcccagctgtgctctcaagtcacacgacatctcagcagagagggacgtggaaatcacagtgaggctgcagcttccaggatgagctgcagactcaggcctgctggagtgagctggccagaccgcaaagtcgcaggacctggtgggaggcaggagatgggagactccagaatatcgagccccaggatgccaccggcccccactgtgaagcacaggtgtcaccctctgccatggtaccctgtccgtcctataaacagcaccctgtgacagaggctaatagatacaataatcacaagccccaggaagagcagacaccgcatccttgtgcctgcggaacgatgctttgagagcctggaaatgagataaaaaatgtatttcaggctgagacaaggctcccttcttcccaccacccacttcctcctcctctgtttacatgccccatcatgtctcatccacatgtgtccagctcctggaggcttaaaaatccatgaagcattctttaaacttctcatcgagtgcctctccctctaagggaagccccctcttataggtgctactgccgtggcccggctactgctgatgccgccactgaccatcttcaagttcaggaatcctcccatttcccaggctaggcatgcaacatggggagagggaagggcttgaggtggaaggtcaggagctggtgggactggtcagctatgggcaacctcagtggcccaggctttgcaaatttatcttaggactttttagataaaatgtatgcattctttcttggtagcttccacacatgatggtcacctgctttctcctggggaggacattagtcatttgctccctgacaacctgagccttgggccttcagctttttgcaggaagcagcctccttgcagccacatcttaaaatggcctgcaggggagctctgtgaaacccagatctgggcattctctcagcacccagctcaggtcagttcctactggccactgagcaaatgtgtacattatgaaaaatcaaatcaattaacaggagaagcagaggtgccgcatagttcctggaaacatagaacctaggaaagaactttggaatcatccagtgcaacaatcccaactcccctccttttatagcaaacattgtccagtgtactcttcattaccctgaaatgaaattcatggataatgttacctgtgttggaataaagtccatttagtacccccacatcaggagaaatcaaaggaaaccaatgtaataaaataatctgcatttctgtaaatattctcacacagccatactgcaaaactcaatgaagcaatcagatcctggcacccatatgtggggtgcccagttacacagagaggggacacaggtgtgctgagcataccctcaaataccccaggaggctctacagtccaaaatggcagctaactcttggtaaagtcccaaacaagccaagcacagccttgcccatctccacagctcctcttccctttgggtggatatagagccgtgcagagcatacccatgtgtacatgttagctctcggcctggccagcaggttgcactgggaagggctgggtgcatacaggtgctgcctaggtctgcaccccaccttcatgctcatatatttgcaggtgcttcctgtgctcaagggctgttctaggtcctttccaggaatacctatttaacccttcccatttcctcttccccactttacagagggggaaattgagaaaggaggaaccatccccagggaatagttgcagccagtgaagggttgggagggtggatggcgaggcttccacaaagacttggcccaagagagtggcatctccaagagaagaggctcaggaagtggtaccccaagtcaaagcctgcttgggataagatagcgtctcagacccaggactcaggaaccttcagggtcgaagagggtagggagggggtgctttgtttcatggaaggtgtcaatgccatctgtggctattcttttcttaaaaattaatatttattggccaggcacagtggctcacacctgtaatctcagcactttgggaggccgaggtgggtgggttgcctgagctcaggagttcaagaccagtctgggcaacatggtgaaaccccatctctactaaaatataaaaaattatctgggcatggcagcatgtgcctgtaatcccagctactcaggaggctgtgacaggagaatctcttgaacctgggaggtggaggttgcagtgagccaagcttgcgtcactgcactccaacctggatgacagagtgagacttcatctcaaaaaaaaaaaaattaacatataagtcaattatttaaatagtttttccctcatatatacaaacagcctgtgagcctctgaggcatatccaggggccacacagaggtcagggcaccctcagtgtgtcctcagtgccttcccccaagggtcccacttaaggaacctagagagcagcacacaggagccctgagggagtccactggttacagatggagggggagatgctggtgtgaacagagagctctgaaacggctgcagactgcaaggatcgaggcttacagatgatcacaccaaggttggccatccctttattgggaacagagactcaacacattcaaaatgtgatacttgaaaaaaaaaaagtttttgcaaagagcagcttaccaatttgtctcttgctgcttagaaacaacacagcaagtttataagtgtctgctagggatcttgggagccaaacagagtacttctacccaccgggccatggaagcagccttccatctgtatttgatgtatggctcgtggttaaatcaaatgctcacctatgctctactattccccaagccacacggaatgtaacattccagttttcaatatgtttgacaatgaaccatgctttttcttgcaggattaatttataataaacagatccaatctctttttaaatagaaatgtatctttacatgttacaagtatcattacatattctgctcaacttgattttaaaattgtgttaaagaatcatttatcggcggggcgcggtggctcatgcctgtaatcccagcacattgggaggctgaggcaggcggatcacgaggtcaggagatcaagaccatcctggctaacatggtgaaaccccgtctctactaaaaaatacaaaaaattaactgggcatggtggcaggtgcctgtagtcccagctacgcaggaggctgaggcaggagaatggcatgaaccagggaggcagagcttgcagtgagccaagatcgtgccactgcactccagcctgggcgacagagcgagactccatctcaaaaaaaaaaaaaatcatttatcaaataccaatcaaattggtctatttgtgtacctatctgaataaaataatggaggaagtatgtaatgcctattacaagacattacggtaagaatcagcttagttcatggtggcaagaaagtttttttttttgaaacttttttttttttttttgagatggggtttcattctgtcacccaggctggagtacagtgccatgatcttggctcattgcaacctccacctcccaggctcaacagatcctcccatctcagcctcccgagtaggtgggactacaggcacatgccacaagcccagctaactttctgtacttttggtacagacggtgtttctccatgttgcccaggctggtctcaaactcctgagctcaagtgatctgtccacctcagcctcccaaagtactgggattacaggtgtgagccactacgcccggccagcaagaaggttttggaaaccagaagtgcccccaaactgaattacgtttgtaattagtctcccttctcttggctactttctaagtttgtcagttgccactgaaagatagggtcagagtgggagtaaaaagcacagctacgcctacccttgtggtgtgtggccagtctcactgggccatatttctttgccactcctctcaggagccccagagcacagaaccctgaagaacctttgtctgcaaaggcccctggctaaggggtgagaggccgaggagctggggttgggggcatccagacttttagctgagacctttgtttctcaagtctgtcatctttgacactgttgacctacagatcacaaagcaccatgaggtggccaggagctatggaagggacttcatggctatggagctctgtcttcagcttatagagtgggcaggtgcccagagagctgagtaacgctgattaaaagcacgaggtgtgtttatccacaatacatctgctgattggttcatgccctaccccaatgaccatcaactcagggacccaaagcactgttccaaagggatgccagccacagttaactccacggaaagaactggctgagggtttttcagtcatgcctgaaggcctggagagaagagaaagcaagagtgcacccagatgccagcctcccctcaggagccctgcctgtcccctcctgagctacaaattaggcacagacacctggatcccccaccagacctccccaagacgtccatgcccacaggaagcgcataccagccaccatcgcccctgattcccaaatgagggccccagccatctctgtgtgatgtgcagtttcctccatctggccactccaggctcctgaggactccatgctcccatgcatggtactggagtgagaacatgtgctccaacaaaaccgcttctgagaggggctgggaggcagcagcaccagccacctgtcctacctgcaggacaggagcagccagcactcactgccctggatgtggggagtgagtttttggtgggccagggtgacatcctggttctgctctctgaggagaccccagttgtcattgtcccacagggccacatctgatgtgtgcacagagtgcaccctctggggctgagagcttcaccacccacttttggcatgagttcaggagcccagaaattgtgttagatgctgaacgctctctcagcctgagagttttttcagcagtacagtttccttaattctggtcagcactttttccagttttgtcttagtcaattcaggctgctgccacagaataccatagactgggtggcttataaacaatagaaatttatttctgatagttctggaagctgggaatacaagatccaggagccagcagatttggagtctggtaagggtgtcctcctcctggtctacacacagccactttttactgtgtcctcacgtggccaagagagagaaagaagagcgctctcgtgcctgttgttataaaggcactaatcccattctcaaggactccatcctcatgccttaatcacctcccaaagaccacacttctaatactcttacatggagactaagctttaacagtgaatgttggaggaacacaaatattcagtcaatagcaagcttagtctatagaccaatgaccaatccaaatatcttatctacatataaactttaggccagagaatgtatgtctgccaccattggccctgatgccccagcctaggggcccgatcctcaggggctggccttggcctcacgtacaggctatcattacttccctcctccctctctgctttgagtttaatttgctaccccttttctagtttcttaaggcagaaattttgattactaatttgagactgttttctcatctaatatgagcattttaatgctataacttttcccctaagtactgctgtaactacaccatacaaattttgatgtgctatatttgcattttcattccgttcaaactattcgttaatttcccatgagacttcctctgacttatggattatttagaaacaggctgtttgagtttcaagttttgggggattgttcaaatattcgttactggtttatagtttcagttatgacatgagcacaaacatcatgatttctgttctttttaatgcactcagactggctaagaatatgttctgtgttggtgaatattccatatgtatttgaaaataatatatactctgctcttgttaggttctagaaatgtcaattacctcaaattctctgagagtgcagctcagttcttctatatccttactggtttctgcctacttgctctgtcagttactgagcaaaaagtagcaaagtctgcagctgtaatacatttgtttatttctctcatttttgttagtatttgcttcatgtactttgaagctatgttgttagcatgcatacacataggatgattatggcttcttggaaaattgacccctttagcattatgtaatgttcctctttttctttggtaacagtccatgttgtggagcctactttgacataaatatggctactctagctctctttccattagtgaatatcttttaacctccatatgtctttatatttaaaatgggattctttttcttttttttttttcctacaacctcaacctctcaggttcaagcaattctcctgcctcagcctcccgagtagctaggattacaggcacacactatcatgcccagctaatttttgtatttttagtagagacagggtttcatcatgttggccaggctggtctcgaacccctgacctcaagtgatccacccatctcagcctcccaaagtgctgggcatgagccacagtgcctggcccttacaatgagattcttgtagacagcatatatgtgggttttgctttttcatccagtctgacaattttatcttttaaaagatacgttttgaccattttcatttaatagtattaatgatatgtttggattaaaatccaccatcttgctacctgttttctatgtactgtatgagttcttttttccttttgtttctcttttgctatcttatcttgggtaaattgagctttttaatggttccgttttatttccactatggacctgttatacccctatttttaattgttagtggtttccctagggtttgcaataaacatctttaattaatgagatttgtttttttttttttttttgagacagagtctcactctgtcactcaggctggagtgcagtggcatgatcttgcaggctctcactgcagcctccgcctcctgggttcaagcgattctcctgcctctgcctccagagtagctggattacaggcacacagcaccatgcccagctaatttttgtatttttagtagagatggggtttcaccatgttggccaggctgatcttgaactcctgacctcaagtgatccaaccaccttggcctcccaaagtgttggaattacaggtgtgagccaccacacctggtctaattaatgagattctattttaagtaatattacttgacttcacatgttgtataaggatattacaacagtgtattaccaatccctccctcccattctttgctattatcagacattttatttttacatctgttataaattcataatgcactgctgccctttgctttagacagttatctgttagagcaattaaaaagaagaaaaaaatgaattttcacatccatttattccatttccatcactcttaattgtgtaaatacaagtttctactggtaccatatttcttgcactttaacatctcctgtagttcaggtctgctggcaatgatttgctcacttttatttgaaaaactctttatgtcttcttcatgtttcagagatattttggctgggtatagaattctagattaacagtttttttttttctttcagcactttaaaaatgtcactccattatcttctggcttacctgttttaccatgaaaagtctgttgtaatttgtacctttgtttttctctgtataatgtatcctcttttttctctggctgccttcaagactttctttttgtctttgggtttcagaagtgttaagaggctattataggaatatttgtggtggtgttactttttcttcttgatgttctcttagtttcttagatctgtgttgatggttgtcattaattttgaaaaattcttagccattatttctttaaaattttattttgcattgttctttccctcttctgggatttcatttacacagaacttaaggtgctgatattgtcacacagctcttagatgctgtgttcagtttcccacctcctttttttctgtttcagtttgtgtcatttctagtaacctatcttgaggtttacagatcagattctttgctcagctatatcaagtcaactgaccagcccctcaaaatcattcttcacctctattatggtgtttttcatttctagcattttcatttctttctcatagatttgttctgtatgctgaaattaaccatcaaatcttgcatggtatctggcttttctattagtccttaacttattaatcagttatttttaattccttgtctgatagtttcaacacctgtgtcatatctgagtcttgttctataaactgctttgtcttttatcaatgtgttgggtttttttttttatctttcctttcgcctcataggttttttgttgtcgttgctgaaagccaggcatcttgagtaggacagtaaagactgcagtaaatcacttttattcctggaaagaagcatgcctttccttttgctaggttttcagagtctaggtttggaccagtctagttatgatagcccaggaaggtcacccccatccccagatccagggatacagtgcctgcctaagacagatgcttaatcagagtaacagaagatgacccttagtgcacccagtgtttgttgccctacactctgcagtttaagcttttattccttggtagaggtaggatggaaatatctatggagacactctcttagaactcctgccagtcttttttgggagaaccaggtaggtcctgtggagaggagcctgcaggtgcatgtgaatttcctttatatcttcagcccccagggttccatattatttcactagctgatactgttcctttaccaatttaaccattttagctgaatgattcttactggggtccagctgaattggcccttcttaagctcatgtctgtctctccttggaggcacctgtctttccttagatattggataagtcggtttccctgtgacttcagctgtctggtgggttaaagataagttgtgaatttgcagtttgactggaatgttttcatggtggaacaatgctcttccagcttttcacatcggagacaaaaaccagaaatcttgatttttttttagaaaataagtactcagaatatattcaggctagcatgagatgatgcctatatgtttccaggctaaaagacatacaagaggcctttcaaaaacaaaaacaaaacacctttccggcctttttaggctcattttgaaaagcagttgctgttctagacatttaccaccagagggcaagccgctgcatggctgctcctcactggtaaagccaggtttccaatagggaaatgtcagggtgtacagttgagaagcagaggcatcctgagcagccgctgctcacgaggaggacctgttttcatggcctcctggccggaactgtccctgggctctgcagccccagccctcaccacaggccgcagttgaccctctgcagaaaagccttcctttgagcccctcggtgtcttcagttgtgagcaggcatgtccgtagagcctctcagtacctggcccttcaccccagccagatctaggccgcaaggctgctggacccttctaggtggacaggcactagccccttcaggggtattcccaccgtgcactggagccctgggcagcccaaggagtccattccagccctgctgttgaggggaggagtccccaggaaccccatgatagggaagtgagggtgactgtctggggtgccgtcttagcttaggtggtttatctgaaacaaacaaaccaaaatcacagtgacttaacacagtggaaatctaaaaggagtgttctcaattgtcaggcagctcttcagtggagatctgctgtcttctgcaggcaccatggaaggggagtggggagagacacccccatgcctgagcacatcacccagcacttcccacattgcttctgcccacagaccatggatgccactaggtgcctgttccccctaaatcctggggccggggtggctaagacatggagtggtggctgggctgatgttctccaacagcaattctaccctgggaagcgggtggacagccagacccaaaatgtccaagttgcacccacaggaactgcttctaacagattattcttgttctagaacaatatttcctgaatttgcttgattttaaaagccacaggagatgcttatttaaaatgttgctttttgagtccctttcctggacactttggtttggcccatccattcatgggggcttggaactcccaggagctgcactgctctattctgggaaacattgtggatggggagagcctgtgccaccccctgccccatgagtaagaagcgaggctaaccccttctctgtttgtgtagtgactcatagaactatgggacaggctgctgggcaccacccaagggagacctgtccctgagccagccctgcagccctccctgggtgtgtctgccctgcagctcagatctggaaagggtggccacgtcaaggcagaacccagcaggctgcagcaaagccaggccaagccacccctgacctctcaaatcagagcactgcactttccaatcccaagccagattaatgaaaagcccggagctggtcattggtcagcaaagctgcatttcccttattggcagcttggggaagctggagaagaagaggtgcgggggtggagaggggaattatttgcacccacttttcctcttaagcaacactggagggcagcattgagtcagtttttccaatttcttaccaaatcaactattggtgttcagtcttcgatttgatctatttccttgcctttttgttcttgccatggcacccttgccatgaaccatgggcaccagcaaagaggcaaagcagctggtccaaggtggctgtgcttctctgctgtgtgtgactcccaggtgtggggcctgcaggggagctaagtggagcccatggaggaggctgctgcttgttgcgaggaaagacttggggagaccatctcccagttcctcctgcccttgtccctgacaatgcccttgggaggagtcaaccgtgtcactaggcactcctctcatcaggtcccccagcagctcagaagctcctagaagatcccaaacctgtagataccccctccaccctagcccttctggagtgagccaggatttcccacgggtggtgagtttcaccacagaagttttgtgatgagtcaatccctctgagaaatgaccagccagtggctcatcactgcaatctccacctacatgtgacctcctcaaaaggaccccctgaccccatccgaaaaaggcttcaccatcactgccttctgcctggtgtttacccttccagggctcatcaccacctgacattatgagatgtttgttaacctgcttatctgtccccagcacaggtgagcttcccacgggcaggggcgggtgggtccatgggtcccaggcactgatacagacttgtggcacaaaattacaaaccagtagaggtcagcaacacccttgctcacctgacttgcacattcggcccttctctgggacgagacaggagagctgagccccaggcccacctgcaaggtggcctcccaaagtgtgcctaacctgcctagatccttcctagaaatagcagaggcagcaatagcttttttcccattctgctgcccaatggagtatctgccattggacagacccaaagagagccagggtccaggtgacgcttccaactgctctccactgtccgcaataaatacgaaattttaaaaactagcaatagtggttttggtcttcatgctcctgctggcacagatctgtgtagatgtccactcggtgcatttgtcacccagatacctggcttgggaatttccttgccatcctgcctggggactgccggggctccaagcacggctctgtctcttctgttccagccgtgatccccctgacggattctgagcacaagctgctgcctctgcactttgcagtggaccctggcaaggactgggagtgggggaaagacgacaacgataacgcccggctggcccagtaagatcctactctgtccctttccccagcgcccacagggagggctatggctggggcatcctggggagggaatgtaccacccctgctcctcctgggacagctggcatgcaagtggactgggtgctataagggccagctcagaccatttcaataggatattcttctcttgccagccttatcctgtcgctagaagccaagctgaaccttctgcacagctacatgaacgtgacgtggatccggatcccctccgagacacgggtgagcctggctgtgctgggaccagacctggcagcagggtccaggctgctcagctccagtctgaccagggtgcatcctcccaaatgctcccacactcttgcctgcccctgcccggccgcccaccccagccatacccacagcccagtagctcctccacctcctttgacctagccatcccagctgcatgcagctggggccaccctggctatggcttgaagtggctctggctggacctagtggctgtgtacacacatgtaggcatgtgtgcatgcaagcatgcgctcttgtaaagggattttttgtccccctattttctgcagaaggaatcaacacgcccactcagaaaacaagccacaggcaagtcacaacacaaaactatctgctaagatcagaacacaatgtgctgccgcagagcggaattaattacaaaccgtgtgggtcctcaaaaaaagccagggaactgagagcgcgattcctcggcgcccccttcctcccctcccagaggcagcacactggtgggtggagctggcaggaaggtgaggagaggggcctacgccccatgaggctgcctgcctccagagggtccggggctgcccctgcttgcaaacgctgagggattcattttaagcatctgactgattgatgttttttgaaatctcagtagtgaactgccagggaaaaggatttgtaaaaaacagcctgcaagtaattggtcctctccagacatttacttaaagtggggctcacaaagaattagtaaaggagtggcatgagtcaaggagtcgggcggtggccagcactgctcagtgctctcagactccagcctctgcctgtacgtcatctcccagggctccatgaggcagggactgataccccattttactgatggcataagtgacagccagtcggtggcagtttgagtcctgcgtctcaaaggcctggagcactcccgtagtgctgtggctgttcttcttcagcacccacatggggagtgatggcagtggctcgagatgtagaatcaggaggctctcgggctgagaatagctctgcctgcaattgccaggcctcggtgccttcatgttagatgcagggctctcagcagacaactgtgggaagggtccttccagccagggactcctgagcccgctctcagtgcgctcctgctagcaccaggcgcacctcccttcctggcccagcccgagtgtccaccctttagtgtctcacgcaccagtctgagacacttcacaccttcctatcccaggtgggaaggggaaaggaatgtcagagtgggaggtggtgagggtcagttctgcccacctttgctttggggtgacctggtcacaggagagtcaccgactcttgaacttgcttgaagggtttgagggggggacaaaaattaagtgggagagcaatgggccttctcccaggctcatcccctggaagccagggacgcctgttcaggtatgagcaccagttcctgcagcacccagcggccagcatgatgggccctgcctctcgtccaatgacactcggtcagaattctctcctcacccagggaggtccctacagagtagtagtaggtgctgcctgcctctctgctctcccacctcttttctcagggtccccccaccccagatatggtcgtgcccccctcagactggttgacctcatcagtgggtctcatccaagaagtgctccccagcgtcaccccaccccacccagggggacttttctgggaatgggaacatcttttttgctgagcgcaggcctatttcagaatcctcctcaatttagcattccaccttgccaaactgagtgagaaaggaactcctgaagcgatttggcatccctgaatcaagggggtgtttgatccaagatccgatgaatgaggttgagtgcaaggtttctgtcccatgcctggcgtgaggtgagacatcttttcagaggaggcacttttgtgcaggcccagtgtcctccccacctgaaggcctccatccttacagaggccagcctgggacctgtgtctggtcaagcaggcggccttgccagtgggggaaggccagagtctgaacctgaccgttctaaattgtgacaaggctctggggaccaagaccaagtagggtatctgcaccctgctgcaataccctactcagggttccagggtaccaagtacctgaggtcccccagagagaaagaatgagtacaccccagcttccctggccagaagacacacgcagttaagaggtccctacatccttttactaccgcagcagatcagagcccactcctatccgctccttcagcaccgcccatccggatgtcacagtcaccagagcgacagtggggactgggacagtgaaggtccagggccctagcctcggcaacacaggggcaaggtgtgtcttcctcgctggcgcgtggacagctcttctctaaccaccttcgatccggccctccctctccacacaggcgcccctggcacagccggagtctcccacggcctcggcaggggaggacgtgcagtccctggccgactcgctggactcggaccgcgattcggtgtgcagcaattctaacagcaataacggcaagaacggcaaggacaaggagaaggagaagcagcgcaaggagaaggacaagacgcgcgccgactccgtggccaacaagctgggcagcttcagcaagacgctgggcatcaagctgaagaaaaacatgggcggcctcggcggcctggtgcacggcaagatgggccgcgccaactccgccaatggcaagaacggggactcggccgagcggggcaaggagaagaaggccaagtcgcgcaagggcagcaaggaggagtctggtgcgtcggccagcacgtcgccgtcggaaaagaccacgccgtcgcccacagacaaggcagcgggcgcgtcgccggcggagaagggcggtgggccgcggggcgacgcctggaagtacagcacggatgtgaagctgagcctcaacatcctgcgcgccgccatgcagggggagcgcaagttcatcttcgccggcctgctgctcaccagccaccggcaccagttccacgaggagatgatcggctactacctgacgagcgcgcaggagcgcttcagcgccgagcaggagcagcggcgccgcgacgccgctactgcggccgccgctgccgccgccgccgccgccgccacggccaagcggccgccgcgcagaccggagacggagggcgtgccggtcccggagcgcgcctctccgggcccacccacgcagctggtgctcaagctcaaggagcggccgagccccgggcccgcggcagggcgtgcggcgcgggcggcggcgggcggcacggcctccccggggggaggcgcgcggcgtgcgagcgccagcggaccagtgcctggccgcagccccccggcgccagcgcgccagagcgtcatccacgtgcaggcgtcgggcgcgcgggacgaggcgtgcgcgccggccgtgggggcgctgcggccgtgcgccacgtacccgcagcagaaccgctcgctgtcgtcgcagagctacagcccggcgcgcgccgccgccctgcgcaccgtcaacacggtcgagtcgctggcgcgcgcggtgcccggggccctaccgggcgcggcggggacggcgggggcggccgagcacaagtcgcagacctacaccaacggcttcggcgccctgcgcgacggcctggagttcgccgacgccgacgcgccgaccgcgcgctcgaacggtgagtgcggccgtggcggcccggggccggtgcagcggcgctgccagcgcgagaactgtgcgttctacgggcgcgccgagaccgagcactactgctcctactgctaccgcgaggagctgcggcggcggcgcgaggcgcgcggggcccggccctgagcggcgcggcgcggcgcgggcggcgaggttctaccttcgaggatttcttttccattgtgtcggtgtcttttttacatgccctggtccaccggaaggccggcgcctcctctgtcagtgccgtgtacgtgtttggtcaaacgttcctaatggtgcctgaacctacactga

SEQ ID NO: 52 - DNA, 138524 bp, Homo sapiens
ggccgcaggcgcaggcccgggcgacagccgagacgtggagcgcgccggctcgctgcagctccgggactcaacatgcgctgctcgccgggaggcgtctggctggcgctggccgcgtcgctcctgcacggtaaagccactgcctccccgccctccactcctccgtgggatcccgggcacatcccgggcgcctctgtgcgccccgcgcctgggccaggtttgggatctccccgccgccggggaggggcagcgggggcgctgcgggggctgcttgtctgggctgcaccgggtgggcggcgggggacgccggcaggagggagtcgggggtacccccgccggcctgccctgagccccctgcccgggtcttctctccttaagtgtccctgcaaggcgagttccagaggaagctttacaaggagctggtcaagaactacaatcccttggagaggcccgtggccaatgactcgcaaccactcaccgtctacttctccctgagcctcctgcagatcatggacgtggtgagtcccgcctggctacagggctgccctctccccttcctgggctccgaggggctttttagacagcgtcgggcggccaggcggtggagctcggctggggcactctagttggccccaagctaggcagggccatgctctgagtctgtccccagcctgccctctcctgagtgtctcatttctcggtttcccctccagccaaggagggacctggtaaagcttattccatcaccctggccacctgtgcatggttacttgggtcccacctttctctcaggttagaaactcaagcatcctgagctgggactcagtagcaagaacaggtgaagttcactttttaatctcccttatggtgtaagtgttgacttgcattccagcattgtcaatttagccacttctagacttttctgccgcctatggtatgtaacttctttggtgggggcctggccctgagctttgcagctggcgaatctatccaggcagagggcaagagggccagctgtgaactttcactgtgaccccatcttaggaatgggcatgctttgccttcctggtgaggacaggtactgggagtcctgctccgaggactcagggttccccgtcaggaatacatgtgtctgtccctccaggcagctgccatcagttccgtgggtctcttgccttgcagccttgctagtgcccacttcagttagccaatctgtgtaaacttgcctattgttcctctatgctgctttggatattcaatattcatggtatattctccatacaatacaaatacttcacacaagtgtttaattcattataagtgggtttggtgtcttgtctatacggagtatcggattctattgtggagcaccctggagtgtggcagggtggggcacagggataataatgttcattgggagggagagcatgatgggaaagaggtgagagaatagccacaattactggttaaaaaagaaatagtgctaagagctacctggcaaagtggaaaaaggtaagaggtgatatttcataatcctacaaataaacagttacccgcactatcatgttgatgaatggtatatcacttaacctagttaaaattgccatcatacattgcctcctttccaacgctacactcgcctcaaatgtgttcttcctcctacagacagaatcatgctttaaaatattgaatgtatatgtgatgatgtggaaaagttatcatgagaagagctgtaggggaaggcaggttcagtctcatgtgttgcagagcagcaaaagttgctgtttatggagcagttcctcagttgctttaaagagctcaggatttgtacttgggatcttcggtgggttctgtctgtgttggtttctggatggctgctgttaggtaagtttcttaagcatcttgagccttggctttccggctaataaaatgcacactgtcagtcattgtgatcaactaaagaatatggaaacaacttgaagagaccttaaagctagatatgtgattatggtcattttcatgcagaaaccacatgaaaaaggaccaggcagcagagctaacacaccccgcaagtggtgtgtgacagggtgagaaagggacagtagccccctcttcccccatttgtccagggtcaactccagccaggctgtcacactgtttgtgtctgctccacagctgtctctcttggagtgggtgaccctgtattgcctggatgggggtgatggtgtagtagcccctcagtagaggaacaggaggaagtcagtagaacaggctcctgaggttgcaaaggctgcggcagcaccttttggagaagagaccactcgcggagaagctgcaggctttcttctgggaacttcttctttaagagactcttaagaaaccaagttattatgaggagctctgagtcttaggagaagtttaggcataagttagtgttatactacatgaacatttaaaataacttttgtcatgttagaaaattacaaaaatagcacattggcactttgtgtcaatgacattccagtgtccttaggaaatgcatgtgaagaaggctgtcagcagccagaggtcatgggaagggggcgggagaaagtttatctctcaccttagccgtggtattggctgtgaacacattgaacttcccagccaggcaatgctatgttcatggagtggccttgaacaaactcacttacctttctaagctctgttttctcatgtgttaaatgagaataataatacctgcttcagagggttttgagaggattaaatgagagaaagtgcttgcccacactggtgattcactgaaggtctgctccatcttaattatgtaactactcaactcagaggtcaagaagtccatgcctagaagggtgtggtcacatgcccaaggtcactctgtgattagaggtagggctatgaggaaaaccaacatcggacaagtcctttgtctttcatctgctgcttcctttagacttggtaacttcggcagaacaaagtcatttaatttatttaaactgggtgaattgtaactaatttaatgtgactttcctgagatcctggatgaagccgaagtctctatcagacataacaaaatatgcaaacatttgtattccagccttacttggctctgcctggtttttgaagcagagccaggtctctccagctgaaatctcagcgctctggacagagacacaatggttctcataaaggcttcgtgtggcaaaatcttggctggtatagattctctttacacatttgttgcccattttaactggactgttctagagaccatagtagttggttttcctactcccaaatattgttattgattgcttttgtttgtcagcagagattcctgactggagtgataggaagacaccatatgatgttacatatttgatttttgtgaaagatcatttactctttaatcaatttattccacacatgctattgagctcctgttgtagactttgacaaattctgagaattaacagaaagatgagggattatttttcctttcagagatctcatgagctggctagggagattaaaaagtaaatccaaaattacatgtgatgaaatttaacataaatatctatacaaagtgctagaaaacattgtgttcaactagagcagctgagagtggcttcaaagagatggtggttagagttctaaagatgagaaggagtttgccactgaaagtaggaaatcttttccaggttgaggaaagactgaaagtgcagtggaggacagctcactttcaacaaggtgtgttttatgggacactggcaacctgttgatctttactacaggttttgctgcaagacttctcagaaaatttatgctatgttttttgagacattctaaaagaccaatatagtactgaccaaactactgatagttttatagacccttttgtaagaattatatgctctagaagcacaccttacaagggggaggctatgatttttctttggtaggaggtgctagatgagtgtggggacagtaaggttgcagtgtgtgaggcgtcctgagttcctctgcaagtttgcatttcacctggccctagtctaggcatctctgagggcatgaggaggcagtgtgccaggggttttgtgaagctgtaagaccagcctgccatagcatattttcctagaaaaggaaatagtccaaaccatgatatttgtattaaattcaagtataaattatagattggagtgaaaaaactttgcatacattttagaggtacaacatgagtcctcaaaggaattgcttgacctgctgttattcaacaggctccttcatgaagcactaggcagagggggaagatatggtgggtcgttaaacaggggagggaagtaaccgaatctctgcttaagcagaagatgctgagagcagtgagtgtgagacgggtcagagaggagagaaaggtaacggacaaggaggttgaaactaggatggccactgtgggaatgtggagaagggggcagatttaagagatgttttggatatattgtctatgatctataactgtgtgtataaacatcatgaatatacatcaataaatttgctaagtgaaagtgcctaaattattcttatatgcacacactgacttctggtgattattaatttacttcctgggcttgtaactgggctgggaatgagataatacataagaaatcattttgaagtgatgcatgtgtgaggttctaatctgccaagtttccataatgtttctttctcctttatttgtgctgtttagtcagtcacctgagcacatgcatctgaaggccattctaagtgatttgcataaaataaatatgcattggttatgaagcatgtccagaagtcaagtttgttaataatatgaaccaacatgtaattatatacaaatgtaaaacacataattatacaagattgactattttggtattttattgatttgaaatgcagactcagctttttggaagctttagtcacaagaccgtagaactaagtggtcatgcacttacgttttggcactgaagatggcaggcagggctgtggagcccagtatcctaagggcttatgtgttatctgaattcctttggggggccctctgtgtaggtttgcaatatgtatgattttacattcattagccactatttaaaatgctacaactccaacaaaatactgtcaaatattataaaacccacatacctagaatatattgtaaaaagaaatgctgaaggtataatcaggtattgatctttatcatttaaaaaaatctttacttttttgagcagttttagcttcacagcaaaatgaagaagaaggtacagagatttcccacagcttcctcaattatcaacattccccactagagtagtatatttgttacgactgatgaacttacattgacacatcatcatcaccccaaatgcatagtttataagaaggttccctcttggttttgtataatctatgggtttgggcaaatgtataatggcataatgtgtaataccctcattatggtatcatacagagtatttttactctcctgaaatttctttgtgctctccctgcttatcactaccttcaccacagctcttggcagccgctgaccttttgttgtctccatagttgaaccctttccacaatgtcgtatggttggaatcatacagtctgtagccttttcagatggacttatttcacttagtaatatgcatttatgctctctccatactctttcatggcttgatagctcactcctttttagcactgaataatatgccagtggtctggatgtagcacagttcatttatccattcacctccggaagaacatcttggttgcctccaagttttggcaattatgagtaaagctgctgtaagcatcttgtgcagatttttacgtgaacataaggtttcaatcacttgtgtaaataccaacgagggcacttgctggttcgtatgctaagagtatgtttaattttctaaggaaatcacagactatctcccaaagtggatgtaccattttacattctcaccagcaatgaatgagagcccctgttgccctttatccatgtcagcatttggtgttgtcagtgttctaagttttaagcattccaataggtgtgtagtggaatctcattgttttatatttgcatttccctgatgacatatgatgtggagcattttttcagaagcttattgccatctgtaggtcttctttggtaaggtgtctgttaaggtctttggccaagttttcagtgggtttttttttttttttcttatttctgaatttaagagtttttgtatatttttgatgacagtcctttatcaggtatgtcttttgcaaatatttttcccagtcagtaccttgttttctcattctctttacattgtatttcacagaacatacatttttaactttagtgaaacccatcttttcaattctttcttttatggattgtgcctctggtattgtatctaaaaagttactgcaatatccaaggtcatacaggttttcctctattatcttctaggagttttatagttttgcactttacatttaggtctgtggtccactttgagttaatttttatgaagggtgtaaggtccgtgtctacatttatctttttgcatgtgattgtccagttgttgtagcaccatttgttgaaaagatgatctttgctccattttattgcctttgcatctttgtcaaagatcagctgattatattcatgtgagtcttatttctgggttctctgttgtgttttgtcgatctctttgtctattctttcatcaataacacagtcttgattactatagctttatcctaagtcttgaagtttggtagtatcagtcctccaactttgtcgttcctcaacattgtgttggctattctgggtcttttgcgtctctctataaactttataattgctttatcgatacccacaaaataaccttctgggatttgattgaatctgtagatcaagttgggaagaactgacatattgacaatactgaatttttctattcatgaacatagaacagctctttagttagttcttcctttattttgtttgtaagaattttgtagttttactcatatagatcttgtaaatactttacttgatttttacctaagtgcttaatttttgaggggttaaatggtattatgatttcaatgtcaaattctacttgttaattgccgaaatataggaaagcgatttacttttacatgttaaccttgtcttctgcaaagttgctgtaattgtttattagctcctggagattttttttttggtcagttattttgggttttctacatgaacgatcatgtcatctgcgatcaaagacagctttatttcttttttcccagtctatatactttttatttcctttttcttgtccttttgtattagctagtacttccagtgtgctattgaaaggagtgggagaggggacaaccttgacttgttcctaatcttagtgggaaagcttcagttttcttatcattaggtatgatgttagctataggttttttggatatgtatatatatatatataaatatacatatgtacatacattttgtgtatatgtaaaatatgtgtacatgtttacatttatgtataaatatgtacatacattttgtatatttatttacatttatataaacatattttgtatatataatatacatattttatatatacatatgaaaaatatgtatatacacacatatacaaaaaacctacagctaacatcatacttaatgatatatatatttatcaagttgaggaagttctcccctattccgtttactgaaagtttttgtgatgaataggagttggattatgtcaaaattgttttcatctattgatataatcatatgatttttcttttgtagcctgttgatgtaatggattatattaattttttaatgttgagccagccttgaatatctggaatgaatctcacttgaccatggtgtataattctttttgtacattgttgagataaatttgctaatttttaaatttttggttgagacggggtttcactatgttgctcaggctggtcttggactcctgagctcagttgatctgcctgtctcagcctcctaaagtgctaggattggaggcgtgagccaccacaacgtgctaatattttgttgagcatttttgaatctgtgttcatcagtgatactggtttgtggttatcttttcttagaatgtctttatctgccatttgtattagggtaatgcaggcctcatagaatgttttaggaagtatttcctctgcttgtgtactctgaaagagactgtagataattggtataatttcttttttaaatttgtagacttcaccagtgagcccttctgggcctgttgctttctgttttggaaggttattattatttgattcaattgctctgatagatataggcccattcaaattgtttatttcttcttgtttgagttttgagaaattttgtctttcaaggagtagtccattttatctaggttataaaatttgtgagcatagaattgttcatagtatttatttgttatccttttaatgcccatgggctgtgtaatgatgtcttctacttctgatattagttatttttgtcctttctcatttttttcttatttagcctggctagatgcttattgattttattgatcatttttcaaaaaacagattttgtttttgttcatttcctctattgatttcctgtttacaattttgttgatttctactctaatttttagtatttctctgcttattttggacttaatttgctcttttttctagtttcctaaagtagaagcttagaatactgatttttagatctttcatttctgtacatttcaatactgtattcagggctatagattttcgcttaaggacttcttttgctgcatcccacaaattttgataagttgtgttttcattttcatttcagttaaaatatttcaatgtctcttgagaattcttctttgaggcatatattatttaaaggcatattgtctaatctccacgtatttttggatttttcagtaatctttctgttactgatttctagtataatttctttgtattctgatagcaggcaatgtgtaatttctattcttttaaatttgttaaggctctttctgtggcacaattatggggaatattccatgtgaacttgagaagaatgtgtattctgctgttgttggataaaatagtctatagatgttgcttatatccaattgatggacaatgttttgagttcaatcatgtttatactggttttctgcttgctggttcttcaaatttctggtagaggggtgttaaagtttccaactgtgaaaatggatttacctatttatccttgtaggtctaatagtttttgcctcattagtttgatgctgtgtttttgggcatatacacattaaggactgttatgtctttttgtagaactggtctttttatcattaagtaatatccttttttatccctggaaactttccttgctttgaagtacgctctatctgaaatttacatagctattcctgctttcttggattagtgttagcatggtatatttttctccatccataagacactgttaatttatatgtgtctttatatttagagtgggttttttgtaggcacatacagttgggtcttgttttttgttctactcttacagtctctttaaattgatgcatttagaccactcagagtgattgtcgatatagttggatcaataactatcatatttgttactgatttttttgttgtccttgttccttatttcagtttttgttttccactctgacttttatggtttagttggacattttatatggttatgttttccctcctttcttggtgtatcagttatagttctttttttacttttttagtggttgccctagagtttgcaatatacatttacaactaacccaagtcacctttcatgttacattataccacttcatgcataatgagagcactttataatgcaaaataacatgaatttcttcctcctgtcccttgtaccatttatttcttataaggtgcgtgtgtgtgtgtgtatatgtgtgtatgtgtgtgtgtgtatatgtattatatatgtatatattatatatacacaaagtataataaaatacatttttgctattgttactttgaacaaactgttatctgttagataaattaataagaaaaacaaaagtttttattttgccttcactttttccttcttcagtggttctttctttaatttagatatgactttcaacctgtatcgtttccctttttttaaagaacttcttttaacattttttcaaggcaggtctgcttgaaacaaatttcttcaatttttgcctgagaatgtattttttttccttatcttttgaaggatgatttcaataattctagatttgtgactttctctctcaacactaattattttactctactctttttgcttgcatgatttcatgtaagtcagatgtaattcttacctttttggtcctctaaagggaagggttttttgtctgcctttggcttccttcaggattttatctttatctttgtttatagtttgaaatgatatacttagatgttggattttttttcccccacatgtatcagcttgctgttttctgagattcctggatgtgtggtttggtgtttgacactaatttggggaaattctcaatcattgtttcaaatacttctgttcctttctctacttcaacagtccccaacctttttgacaccagggacctgttttgtggaagacaatttttccatagactgtcgggggccatggttttgggatgaaactgttccacctcagattgtcaggcattcattagattctcataaggagcgtgcaacctagatcccttgcatgtgaaattcacaatagggtttgtgttcctgtaagaatgtcacgctgccgctgatctgaccggaggcggagctcaggcagtaatgctccctgacctgcccctcacctcctggtgtgtggcccagttcctaacagtccaggtgacaggtactggcctgtggcctgggggttggggaaccctgctctacttcttctccttctcgcattcccatcacacatatgttacaccatttgtaattgtcccacaatccttggatattctattctgttgttttcagtctttgttctctttgcttttcagttttcaaaatttcgattgatattcctcatactagggattctttcctcagctgtatccaacctactagtaagcctatcaaatatattctttatttttgttacattatttttgattgctggaatttctttttggttatgtcttaggagttccatctctgtgcttacattgtttaactgttcttgcatgatgtctgctttttccattagagcctttagcttattaatcatagttgttgtaaattctgatctgataattccaatactgctgctatgtctggtactaatgcatgttctgtctcttcaaattgtgttttttgtttgttttttgccttttagtatgctttgtaattttttcttgattggtggctgtgatgtaccaggtaaaaggaactgctgtaaattaataagttactaatgtagtgttaaggtgtggagggaggggaagcattctatactcctatgattaggtctcagttttttagtgagcctttccctctggacacgaacttcataggtgtttctcagtttgtttctccccacttgagtgcgataggatggctagagtgggtggagttcagtatttcccttcccttgtgtcaggtaagctctcataataccccggagggttagactctggttaattcatttctcctgatggcaggccttattaaaaacaacagaaaattctggcacatttccaagtggtttctttcacttccctctggtggaaggatgagggaacatttcttcagtatttcctgtgggaacctggtagagcttctggaggtaaatctcatgatatttgggaaccccctatgattgaatccttttggaatttttaactttcaaagttgtacacactgagcctccaggaatttgccaattccagtttcaggttttcttactctgctgctggttcctgtggtggttttgctgattagtctctgctctggaaagtcctggctctctgtatgtccctgtttgtccccctaatcttgagagcagaagttcatcctgtgtgttcccctcttagttgggctccaagaagagctgttgtttttctagtgtgttcacctttttacttgttaggacaaagttcattctgagcttcttgcatcaggaaccaggaactggatctaataatgtttttataagatacatttcttaaaatgacaaaagtaatatgtgtttgtacaggagctaaattaaacaaaccaaaaaaagaatcaagaagttgaaaatcaagggggtaaaaatcagcacacacaaggcattctggcagagttcatgctatcttttctttatgtttatagatgtgtagagaaatatttaaatatttaaaagttaaaaggtataaacatgatgtatggtgccttaagcagtattaacaggcattgattttaaagtggtacacttaggcccattagtaaacaaatacagattttaaaatacatttatatgttttcttcattaactcttaccatcactgcatattcaatctatattccttttgtaatttaaaaaccattttaaaaatgtgtttaaatgatttatgatgatacttataagtaacacatagttgggtttttaaaaaaattgaatttgataatctttgtattttagttatccttcatgtggttactgatctatttggttttaaatctatccttcactgtttacttccacttacccttgtctcttctatgttctttttttcctcttttttcttacacttttctggattaattgctcattttatattattctaattttctcttctattagtttgttagtcatatttctttctttttgtcttacagtggttgatctggagattacaataggaatccatgactaagtaaagtctagtgaaagtcgtcaacctttctgtacaatgtgaggactttacaacactttaattccataattccaatttatctactgttattgtcatatattttatttctataaatatatttaaaccttataagattataattgtcttttacagtcagtattcttttagatttactcgtatatttaccttttttgttactttaattcctccctgtatcttctaactttcatctgagataattttccttctgccctttagacttctctttcttgagagtctggaagtagcacaatttctccatgtttgtttcaaaacttatttatattgcctaatttttgtgtgataattcagaaatacagactttgtgttgccggttagttacagcacttttatatacagcatagtgtctatagtcgattaccctagtgttttctgacttcagtacttctcttaagaggtcagctgtatgccttactgttgcttctctgttcttgttttctttggtcacttttaaattttattctttgtctttgatttttaacagttttgctatgataagaatatgtttctgctcttttgttttacctgcttgggattcagaatgacttattgaatctgttccttggtttcattcacaagttttggacaattgttgccagatcgatcgatcttttcctccttccttccttccttccttccttccttccttctttttttggggatggagtctcgctgtgttgcccaggttggagtgcaatggcacgatcttggctcactacaacctctgccacctggattcaagcaattcttctgcctcagcctcccgagtagctggaactacaggtgtgcaccaccacgcctggctaatttttgtatttttagtagagacaggttttcaccatattggccaggctggtctccaactcctgacctcatgatccgcctgcctcagcctcccaaagtgctgggattacaggcgtgagccactgtgcccggcctagatatttctttagatatggcttctgctctattttttctgccttccctttttgggacaatgattacatgttcaccacagctttcactttatctcagtgattctcaaccaggggcagtgtctctccccagggaatatttggcattatcttgaaaaaatttcagttgccccaactggggagaaagatgctactgacacttacagggaagaggctagggatgctactaaatgacctatagtgcatagggtgactcctcaagaaaaagaattatctggcccccaatttcaacagtgctgagatggagaagactaatttattccatatgcctcctattctttgcggcaattcccattactttgtctctccatgcttcatccggtccgttttctgttgacatatattcaatattcagtccttgaattctctcattgtgtctatctgttgttagtcccatttattgactcctttttaaagtttcagatattgcatgctttagtgttaagagtttccttttggttcttacgatgttttctagctctcaagcttgttctgattttcttcaaatatattaataagacttttttttatagtccctgtctgataattccattcttaagacactttgtgcctctgtttttattagtgatggctctttttgcttttctgttacatggtctgtgctccttctgagcctggttgtgtttgtagtttgtcccagacaatgtatgggaaaaatggtagagatgagagaacggagaacacttttactcctgttaatatttgcttctgacaacagccaccccatgggtaccagcaaccacacataaccttaattagattagggattgagaagatacgaagatgggcttcagtccctttaagcgctggtttgtttctggttcttgcatatacattctagggcataaatacagagaatttactagagtcttctctctcttcaataagtttttttttttttgagacagagtctcactttgtcacccaggctggcatatggtggcacagtctcggctcactgcaacctctctctcccgggttccagtgattctcctgcttcagccttccaagtagctggtatttttttttaatattttaagttttagggtacatgtgcacaacgtgcaggtttgttacatatgtatacatgtgccatgctggtgtgctgcacccattaactcgtcatttagcattaggtatatctcctaatgctatccctcccccctccccccaccccacaacagtccccagagtgtgatgttccccttcctgtgaccatgtgttctcattgttcaattcccatctatgagtgagaacatgtggtgtttggttttttgtccttgggatagtttactgagaatgatgatttccaatttcatccatgtccctacaaaggacatgaactcatcattttttatggctgcatagtattccatggtgtatatgtgccacattttcttaatccagtctatcattgttggacatttggcttggttccaagtctttgctattgtgaatagggccacaataaacatacgtgtgtgtgtgtctttatagcagcatgatttatagtcctttgggtatatacccagtaatgggatggctgggtcaaatggtatttctagttctagatccctgaggaatcgccacactgacttccacaatggttgaactagtttacagtcccaccagcagtgtaaaagtgttcctatttctccacatgctctccagcacctgttgtttcctgactttttaatgattggcattctaactggtgtgagatggtatctcactgtggttttgatttgcatttctctgatggccagtgatgatgagccttttttcatgtgtcttttggctgcataaatgtcttcttttgagaagtttctgttcatatcctttgcccactttttgatggggttgtttgtttttttcttgtaaatttgtttgagttcattgtagattctggatattagccctttgtcagatgagtaggtcgcgaaaagtttctcccattttgtgggttgcctgttcactctgatggtagtttcttttgctgtgcagaagctctttagtttaattagattccatttgtcaattttggcttttgttgccattgcttttggtgttttagacatgaagtccttgcccatgcctatgtcctaaatggtaatgcctaggttttcttctagggtttttatggttttaggtctaacgtttaagtctttaatccatcttgaattaatttttgtataaggtgtaaggaagggatccagtttcagctttctacacatggctagccagttttcccagcaccatttattaaatagggaatcctttccccattgcttgtttttgtcaggtttgtcaaagatcagatagttgtagatatgcggcgttatttctgagggctctgttctgttccattggtctatatctctgttttggtaccagtaccatgctgtttggttactgtagccttgtagtatatagtttgaagtcaggtagcgtgatgcctccagctttgttcttttggcttaggattgacttggtgatgcgggctcttttttggttccatatgaactttaaagtagttttttccaattctgtgaagaaagtcattggtagcttgatggggatggcattgaatctataaattaccttgggcagtatggccattttcacgatattgattcctcctacccatgagcatagaatgttcttccatttgtttgtatcctcttttatttcattgagcagtggtttgtagttctccttgaagaggtccttcacatcccttgtaaggtggattcctaagtattttattctctttgaagcaattgcgaatgggagttcactcatgatttggctctctgtttgtctgttattggtgtataagaatgcttgtgatttttgtacattgattttgtatcttgagactttgctgaagttgcttatcagcttcaggagattttgggctgagacaatggggttttctagatatacaatcatgtcatctgcaaacagggacaatttgacttcctcttttcctaattgaataccctttatttccttctcctgcctgattgctccggccagaacttccaacactatgttgaataggagtggtgagagagggcatccctgtctgtgccagttttcaaagggaatgcttccagtttttgcccattcagcatgatattgactgtgggtttgtcatagatagctcttattattttgagatacatcccatcaatacctaatttattgagagtttttagcatgaagggttgttgaattttgtcaaaggccttttctgcatctattgagataatcatgtggtttttgtctttggttctgtttatatgctggattacatttattgatttgcgtatattgaaccagtcttgcatcccagggatgaagcccacttgatcatggtggataagctttttgatgtgctgctggattccgtttgccagtattttattgaggatttttgcatcaatgttcatcagggatattggtctaaaattctcttttttggttgtgtctctgctcagctttggtatcagaatgatgctggcctcatgaaatgagttagggagattccctctttttctgttgattggaatagtttcagaaggaacggtaccagttcctccttgtacctctggtagaattcggctgtgaatccatctggtcctggactctttctggttggtaagctattgattattgccacaatttcagctcctgttactggtctattcagagattcaacttcttcctggtttagttttgggagagtgtatgtgtcgaggaatttaccatttcttctagattttctagtttatttgcgtggagatgtttgtagtattctctgatgatagtttgtatttctgtgggattggtggtcatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgctgttagggtgtcaattttggagctttcctgctttctcttgtgggcatttagtgctataaatttccctgtagacactgctttgaatgcatcccagagattctggtatgttgtgtctttgttctcgttggtttcaaagaacatctttatttctgccttcatttcgttatgtacccagtagtcattcaggagcaggttgttcagtttccacgtagttgagcggttttgagtgagtttcttaatcctgagttctagtttgattgcactgtggtctgttcttttacatttgctgaggagagctttacttccaggtatgtggtcaattttgggataggtgtggtgtggtgctgaaaaaaatgtatattctgttgatttggggtggagagttctgtagatgtctattaggtctgcttggtgcagagctgagttcagttcctgggtatccttgttaactttctgtctcgttgatctgtctaatgttgacagtggggtgttaaagtctcccattattattgtgtggcagtctaagtctctttgtaggtcactcaggacttgctttatgaatctgggtgctcctgtattgggtgcatatatatttaggaaagttagctcttcttgttgaattgatccctttaccattatgtaatggccttctttgtctcttttgatctttgttggtttaaagtctgttttatcagagactaggattgcaacccctgcccttttttgttttccatttgcttggtagatcttcctccatcctttaattttgaggctatgtgtgtctctgcacgtgagatgggtttcctgaatacagcacactgatgggtcttgactctttatccaatttgccagtctgtgtcttttaattggagcatttagtccatttacatttgaagttaatattgttatgtgtgaatttgatcctgtcattatgatgttagctggttattttgcttgttagttgatgcagtttcttcctagtctccatggtctttacattttggcatgattttgcagcagctagtaccggttgtgcctttccatgtttagtgcttccttcaggagctcttttagggcaggcctggtggtgacaaaatctctcagcatttgcttgtctgtaaagtattttatttctccttcacttatgaagcttagtttggctggatatgaaattctaggtgaaaattcttttctttgagaatgttgaatattggcccccactctcttctggcttgtagagtttctgccgagagatccgctgttagtctgatgggtttccctttgtgggtaacccgacctttctctctggctgcccttaacgttttttctttcatttccactttggtgaatctgacaattatgtgtcttggagttgctcttctcgatgagtatctttgtggtgttctctgtatttcctgaatgtgaatgttggcctgccttgctagattggggaagttctcatggatgatatcctgcagagtgttttccaacttggttccattctccccgtcattttcaggtacaccaatcagatgcagatttggtcttttcacatagtcccatatttcttggaggctttgttcgtttctttttattcttttttctctaaacttcccttctcacttcatttcattcatttcatcttccatcgctgatacccattcttccagttgatcgcatcggctcctgaggcttctgcattcttcatgtagttctcgagccttggctttcagctccatcagctcctttaagaacttctctgtattggttattctagttatacattcgtctaaatttttttcaaagttttcaacttctttgcctttggtttgaatttcctcctgtagctcggagtagtttggtcgtctgaagccttcttctctcaactcgtcaaagtcattctccatccagctttgttccgttgttggtgaggaactgccttcctttgtaggaggagagtcactctgctttttagagtttccagtttttctgttctgttttttccccatctttgtggttttatttacttttggtctttgatgatggtgatgcacagatgggtttttggtgtggatgtcctgtctgtttgttagttttccttctaacagacaggaccctcagctgcaggtctgttggagtttgctagaggtccactccagaccctgtttgcctgggtatcagcagcggtgtctgcagaaccgcggattttcatgatccgcgaatgctgctgtctgatcgttcctctggaagttttgtctcagaggagtacccggccgtgtgaggtgtcagtctgcccctacttgggggtgcctcccagttaggctgctcgggggtcaggggtcagggacccacttgaggaggcagtctgcccgttctcagatctccagctgcgtgctgggagaaccactgctctccttaaagctgtcagacagggacatttaagtctgcagaggttactgctctctttttgtttgtctgtgccctgcccccagaggtggagcctacggaggcaggcaggcctccttgagctgtggtgggctccacccagttggagcttcctggctgctttgtttacctaagcgagcctaggcaatggcgggcgcccctcccccagccttgctgaagccttgcagtttgatctcagactgctgtgctagcaatcagtgagactccatgggcgtaggaccctccgagccatgtgcgggatataatctcctggtgtgccgtttccgaagcccgtcagaaaagcgcagtattggggtgggagtggcccgattttccaggtgccgtctgtcacccctttccttgaccaggaaagggaactccctgaccccttgcacttcccgagtgaggcaatgcctcgccctgcttcggctggtgcatggtgcgctgcaccgactgtgctgcgcccactgtctggcactccctagtgagatgaacctggtagctcagatagaaatgcaggaatcacccgtcttctgcattgctcaggctgggagctgtagaccggagctgttcctatttggccatcttggctcctccccaagtagctggtattacaggcatgcaccaccatgcctggctgatttttgtatttttagtagagacggggtttcaagacgttccccaggctggtcttgaactcctgacctgaagtgatctgcccgccttggcctcccaaagtgctgggattgcaggcatgagccactgcacctggccctctcttcagtaagtcttgagctcaaaattttccacttttctcttaagtttgtcaaggtttgcttaaaattttagcctcttaagcattattaaataatcaccacaggctctggaaaggtggcctcaaatcttggtattctctcagggctcccctctcttcctggatcttgtccctgcaattcctcactgctctattagtattctggtgcccttaagcatgatttttttttttttttttccccaagctcttctaattgttctcactggagagttgatgagaaccacctagttgatcatcactgatagcagaacagaaattctaagtggaaataaatatcatatgtgctctctaatttgtggaagctaagaaagtggatctcacggaagtagggagtgtagtggtggttaccagtgactgggaagacagtggggagaggagaagttggttaaagggagtaagttagatggaagaggccaggtgcgttggctcacacttgtaatcccagcagtttgggaggccaaagagggtagatcacaaggtcaagagattgagaccatcttggccaacatggtgaaaccccatttctactaaaaatacaaaaattagctgggggtgatggcgcatgcctgtagtcccagctactcgggaggctgaggcaggagaatcgcttgaacccgggaggcagaggttgcagtgagccgagatcgcgccactgcactccagcctggtgacagagcgagactccatctcaaaataaataaataaatacaattaaataaaaaagttagatgaaagatatagttagatagaaggaataagttctagtatttaatagtatagtagagaaattatagttaacaataatttattgtacatttcaaaataactagaagagcagacttgtaattttcccaacataaaagataaatgtttgaggtggtagataccccgatgatactgatttcatcattacacattgtctgtgggtatcaaaatatcacatgtacctccaaaatatgtacagctattagatataaataaaaaaatctgtaatgcacctttataattgataccaatttattatggttgaaattttgtctcctaaaacctgaagaggtttaggagacagagccctgaagagggctgtgggagataaacccacaaaattcttttaatctgtatagactgagaattgtaagcacttttactaaaggaatctttcttgtaaatgttgcctttcaaggctaccactgaagatattccctgaagggttcagctctctcagagcttctcgtttcatctttgacatgctgttaaaggaagagaaatagtcttgtcatggaggaaggccaacgaaaatctctgctgccttattgatttatttttaaaatcaggattaggtagtgttttactcctcctcaaagaagagggaagtcatttggcatcttctacttgcagttcccatgctcttaatttcagtgatttccttattcagttaacatcagttataaaccattatagccaaagaaattcaaaaagtattgtaaaatagtatgtacttgggcatatttatgtgtgtgtaaatgcacactcagtcacacacacccctgttatccttagctctccttgttgattttatttttgatatctcaagacaaggtatcatgtactatgctaattaagtttccaagatctaaagcttgaagataccgcagaggccttggagtcacagctcccaggtagccaaaacaatggactgaaactaataagaaattaagcaatgaattatacaaaatcttgtattacgggttaaaaattagtgcagaagaatgggctgtgggaaaggcctggatgtgtggctgactactggctctgcgtcagctcgtaggtgtaggagctgacctgtctaagctgtaggtggcagtggacgaggagtaggaaattgcagttgtcatggttaatgaatgccacctgtgagagattctcagcatgggaaatttactcttgcatcattggaagtgaattgtctgtaaatattcctgtcttggataaaagagccatggtgtctatactctggggagaggacttagagagggaggagaacttatttactttattttgtggagagaaggcacgtgttaggctaactctttagttggtttcaaatttcaggattgttaaatgagtttataatctaaagtatctattttaagaagtccacacagagaagatattatgatcagagatttagattaagcaaattagggtaaggctgctcactgattgccaaagtatatttcattaagtgcaaatggatgaaatttacaattgaaatcactagtcaggaaacagtttgtttaagttctccattaagaagttttattgtcatttgaagtaacctttaacacactgtgttaaaggtctctcgtagagagacacacatcttattttggaagttattctttaaccctattctaaaactttaaattgtagtagagtagatatacactaatgtggcacgatatcaaaaccaattcagtgggttaccacaaagtgaaccccgttaagctgtcaccacccaatacagaccttcgctcctccagagctaaactgtttgccttacttcaaacaccaaagtctagttttgcccttctctggaactctgtataagaggaatcacccaagcacacagcatgcgttctttgggatctggcttttttggttcatttttatttttgtgagccacccaagttgttgtctgtagctcttctttcttcatttctattgtatgaatataacaacatgtattattatattgatggctatttagatttcttctagattttgtctgctttcaagaacacttcaaggaatgtgttacatgtcttctgacggacaggagtatgcatttctctctgatacagacgtaaaagtagattggcggggccatagggcagcgtgtttttaacttttctggatgatgctaaacaattttcaaaatggttataccaattagcattcccaccagcagtgtatgaaaattcttgttgctctacatactcaccaacgcttggcatttttagtctattaaatttaccattctagtgggtgtggagtgacattttcttgtgattttaattagcatttccctgattacagctaaggttgaggagattttcatttttttattttccattttgatatattattttgagaagtgtctaatcgtgtctctttactatttctctctctcttttttttttgttttgtgttggtttgtttttttctttattgatttgtatgagtttttctgtattacagatataaacccgtagtcattgtctttgttttgtgctgttataacagactggagactgggtaatttattaaaaatagaaatttatttctcatagttctggggatggtaaagtctgatatcaaggtgccagtatctggcatatcttgctgcttcacaacgtggtggaaggcatcacatggcagaagggcaaagagtgggtgtgagagagagagagcaagagggctaaacctgctcccttcataatgaacccactcccaaggtaactgcattagtccattcaggagggtggggccttcatgacctaagcatctcttataggttctgtctcccaataccatcctagtggaaattaaatttcagcatgagttttggaggggtcaaacattcaaaccattgcagttggccaggcgtggtggctcatgcctgtaatcccagcactttgggaggccgaggcgggcggatcacgaggtcaggagatcgagaccatcctggctaacacagtgaaaccctgtctctactaaaaatacaaaaaattagccgggcgtggtagcaggcgcctgtagtcccagctgctcaggaggctgaggcaggagaatggcgtgaacccgggaggcggagcttgcagtgagctgagatcatgccgctgcactccagcctgggtgacagagcgagactctgtatcaaaaaaaaaaaccaaaaaacaaaaccattgcagttatatgttttgcaggtatcttagactctttggcttattgttttactttttgacattctttcttttctccttttgtaaactttcaattgaagtatgacatgcttacagattaatggtgtcttttggtgaacagaaattcttaattttagtgtggcctagtttagaaatcctttcttctacatttagtgcttacagtgtcatattttaaaagtctttcccttccccaagttcatgaagatatttttctgtattttttagaagctttccattgttgttttagtgaatttttgttactgttttacctctcatgtttgtttataacccacctagaattgatttttgtgtataaagtgtatcacttttaagcagttttatggaaattggactggtgactaatttattttgtttttcaagagttgtgaaagggttgttagtggaattaatgcatgattgtttaactgtatcacatttggacattgtattgtccactatgcctgtgccctaatggacattttaattatttaatgtgtgtatgatatgaaaataatgtatgggtaatggaaatttttaatatttaaaaatgttgacatcacacacattatttacaaagtcagtagtaaagaagggcttatgagaagccctagcccctggccccaggtttcccatcaccatcctaagacaggtacttttaacaggctctgtttcaggtcatcactaatattttaacattctgcttatgtttctatttcttgattgattaaaatatcaaattctctggacctttactgaaattaaaatgcctttaattaaatatcttcagtatggatgttcttatttttaggagggattttgttaacaaagaaaacattaggcaaattcaatttagcagacgttatatgagcaaagaacaattcatgaatcaagcagcactcaggaccagaagaggttcagagagcttgactcagtagtgtgagcaaccagcttttataggctgaacacagaagcaaattagataatctgattggctaccactaggcacttgtcttacttggcatggggtgatgaattggctgcctgtgattggctgaaatctagctgttcatggttagctgaaactctgctgttatagtcctaagttaggttttggtttgtttgcttaataaattaggttgcctttgttaagtaggaactcaaagatgggagatagtctccagccagtggccttctgcttatttcatttagcagtttgtttattaggaatggcagtgtgtccctcaaatcaggatctgatgatgaaggttgttggctaatgattgagatagagatgggtttttttgtttgtttttgtttggatgcctatctgactctgaaggaaaagaaaaaaatttccctaagtttcttagcaaatcaaaagccttctacactgactgattttaaggataggctgtaattaggtaatgaacattttggtgtgttaacttggaaaaccccaactttatagccatagctaatatattcactgaaatatatttcgggttttgaaaatcaattggccaaaagctttaaaaacattctttttaaaaacaacatttaaaaactttcttgcagagttttcctttaaaaataaaaagtgctactttttaagcctttgatcaaatgttgacactcctcaactttgtgactgaatcatttaggacaatattttaaatttgcctaaaatatctgtaggttaaagatcaagaaaatttcttgattaaaagtgaaaggataacagatatgttgataaaaatggacaacgtccatagaatcctgatacttgcagacattcaggtgtttgtagttactcttcagggccacatcctataaacaactagaaatcaggatatacatgtaagtcaggtaaatttcagacagcctgtaatgtttcaagcaggaagatgtctccagatctgtcctggaggcttccctgttctttatattaccggtcttgcattttacaacttcagactaaacagaaactgtatcagaggcctttgtcttagtgatttaggccagggagtgatttacactgactagtggtcctaggagcagtaggcttttaattctgcttcctgcactctaggattgactatcatgctgttgaagatgatgtgtggctgcagggtgcacctccttgcctcctttccctctgaaacatgcagggttgttcggaccctccatcctcttccatgcacaaagcagttaatgcaaattccgtggtccaagacaatcctttgacagtaaccatcagtcatgcattaaaacagcagtgtacagatggtaccttcattgtttctgacagggacagttatgggcattggattaaagtaaaaactgaaaaggaatattcatgacaggaaattttccctttccgggggtgttttgcaacagcgggaagcagctggtcattgatgtgtcggcacaaggcagcttcctggatttccactggcttcctggatttttccaggtgtcacttggaaagtgtactgaattagtgcttgaaacttagtgttagagtgctcgaaacttagtctcaaatagaggaaatgaacacagagtaggatacataatgtggcattgtttggattgggaatgctgtacttatttcagaaatgccactcttttggaggaaaattagtttcctccttactttattgttaaatctgggaaatctggaaagggctgtgggggcagaactagagtgggctggtattcagggcctcctaataggtggctttggttgtgtgactttggatgcatatatcactgtgtatatttgaaaaaagccctaaagtaacatcatctatatgtatataactttaaagaactttaacatttttaaagcactttcactgatgtttgtctctttgatgatcatgtgaaatggtgttcttaatgactgtacctgtctaggcagagaacattttgggacctgaacccaggtcttctttgtatttttttttttctttttgggacagagtcttactctgttgcccaggctggagtgcagtggcataatcttggctcactgcaacctccgcctcctgggttcaagcaattctcatgcctcagtctcccgagtggctgagactacaggtgcacaccaccatgcccagcacatttttgtattattagtagagatagggttttaccgtgttggccaggctggtctcgaactcctgacgtcaggtgatgtgcccgccttggccttctgaagtgctgtatttttttgttttcaggatatttctgtttatttgctcattaaatgaatggattatgcagtagccaagataattgaaataggtgaccagtgagattttattttcagtttgaactattgatttttttggcatttgatatgttttactccattgcagttattctttctgatgcttgaactgtcagattggctcctgcattgttttgctttggtcactgtgatccttaatcatttcttctatttcctggcagaaaataaaataaggtgtcctgggctcactgtgtgtacctcccaccacagactggaatctgcctttgctaaggagcattacagtgggaaattaaatttagaagccacagactgacaggaggtattggaagaaattccaacttgagtctaacagatatctcagaaagagacaactgagcgaatgggaagtacagatatagagaaatgatttttttttgttttgtttgttttctaaaagcttctagatttgagggaaaacacaaacacatacttagaagcagcagacccacttcatccttcaattccagtacatcaggtgtaaggaaaaaaaggctatttaggacattacagagggctataacgcccaagctccgatgagaaactgattagtatcctaagatctctgaaacgccaagtagaaaagcaaaaaaaaaaaaaaaaaaaaaaaaaaaaaagtgttttcatgtatgcaaggattcaaagtttaccacccacaaattatctgaaagaattgctggaataatgtaatccagttatgcaaaaccaaaatcaaactctaagcagaataagtgagatataataaatccaagcagttagagtccagaaaatttggcattaagcctaattgtcagttgtcaaacatcccatgaaacatcaacagcaatctataactgaaacttcagaattcactctacaaacggtcctggaggagtgagggtagtgtatttcagaggtagaaaaagcagagaagaaatgcattctaagatacttttctatatctatatcatctatttatatgtatacctgtatatacatacctgtgtgtgtgtgtgcacgcgcacacacgcacgcatatggactgatttatgaaggcatatatagaaaaaataaattatgcattttcacataactttcacataaacttgtaaataaccactgtaagaatagaaataggatataaagttttcaaaccttgaagggcaataatggaacaaagaaaactgaacaatccaataaaactaagaaatgctttaagaaaacacaagaaaagtctggtaaacaggcaacatattatgacaacagaaacccaatcttatccgtaatcaccatgttgtgaattggacattttcagttgaaaatgttccagctatggccactttcaagagatagacttaaatcacaaattctcagacaaaaataagtaaataggcagataggcaaatggagatggggaaaagctgcagcaagcagatattaacagtggttacagaactgtatcttgctgtaatgggggctaattgaggaaaaccatctgcggcgggagggcgtgtcttcactgaggtgcgatggcattgttggctgctgaagcaggcatcagagtccgagaggaggacagagcacgtagccacaggatgagcacacccaccaagggctgatatgcagagctgcctacccgaggagcattgtgggccaggagagctttggattcatcacaagagcaagagatgcatggcagccctgtttcacaataagcatgttatctcactcagtccttgtggcaagcccattggatgtactgtcattctcccgatgttgttgattggataccaatgctggccagattcatggtgcttgtaggagtggaaccaccatgctcagcgggactagacagctgccaaacagtggaggctcaggaaaccccttcacttaagtgccagcctcacccagcccggacctgggaggaagccaggtagtggcaacagaagaggaggaaggaaagtcatccaggcacgtttcctgcgtggaaagaacagcctaagattgctcaaggtctggttcaaatggaggtgtccataaagagacttccagatcccttcccatcagaattaaccttttgcactcccacaataccgaaatactttacttatttatatgtggctattaggacaattcagagagagacaaaatgtttgaattcacaagaacaacatttaaaaatgagataaggccaggtacggtggctcacgtctgcaattccagccctttgggaggccgaggggggtgaatcacttgaggtaaggaatttgagaccagcctggccaacatgatgaaaccccatctctactaaaaatatagagattagccgggcgtggtggcaggtgcctgtagtcccagctactggggatgctgaggcaggagaattgcttgaacccgggaggcggaggttgcagtgagctgagattgcatcactgcccttcagcctgggtgacagagtgagacttcatctaaaaaacaacagcaacaacaaaaaacaccaaaaaaacaacaaaacaaaacaaataagatgagaccctcagtaattatgtgagcttgggaaagctaccacacctcttacattctgttctttaaagtaataataattcctgtgatattgtcacaatactcatgattggtgatactttttaaaattaacattttggtaatataactcttgcccatagtttaaaagctgagataattctgtgaggattattgttctctgcttccatttacatttctcatagacaaccaattctaactcttttagctgtttctttgagatttacgtgcatatcttgaaataaaatgcttatattaccactttttgctttagttctgttgaacaatggagaacctcacaatactgaaggtgaggacttagttctctgttcactctctacctccactaccacgcataattaacacacttcccttcatttatcacatttacctaatgaaattacataatcatttttgtttaaattaatatataatgtttatattaaaatctgtaaactcatgattcacagctgagagccatgcaataggctatattccttttccttagagttaatactattatctttggccggttgttgaatttttcatgtaatgatcactattctatccccaaactctccagtagacctgtaattttctctccccatgttcagacacgtggatctgtgtcttccatgttgttagagacatcttttgaagcattttatcctcctgcttgaatgtaaattgattgtttcctagctctgttctgcagctgtcagactgatattttcttttatgattgccttttgtcaacagctttctgacatcaactgagtattctatgacccagttcgattcagacactaccttgcacttctgcctggccatctacacatttggggcttcctacaacttcctcacatttgttaatttgctataacaactcccagaacttggtgctaaatagtcatttgatgatgaggatgcgttctgagaaatgcattattaggcgatttcgttcttgtacaaacatcagagtctacttacacagacctaggtgttatagcatactacacacttaggctatatggtagagcctattgttcctaggctataaacctgtacagcatggtgctttactgaatagtgtaggcaattgtaatgcaattgtaagtatttgtgtatctaaacatagaaaaggtgtagtaaaaatacagaataaaagataaaagaatgatatacatatacagggtagttaccgtgagtgcagcttgcaggactggaagttgctctggtgagtcagtgagtgagtagtgagtaaatgtgacggcctgggacattactgtgtgctactgtagacttcgtaaacactgtacacttagactacactaaattaaaaaaaaaaagtaattgcactgtgatgttatgacagctatgacatcactaggcaataggaattttttagccattataatcctatgggaccactttcagatacgctgtccatagttccctgaaatgtcattatgtgacacataattgtccttgtgattattgttttattataaaaatgcaaatgagcttccaggtgaaaagttacataggacaaagtctaggaagtcctaagcacagggtcttctgtctctgtggagaccagcagtgccatcctcttcatacattgatgtgttcaccaaccaggtagtttccccaagccttgccgtctggagttattgatggagtttcattttgtatgcatgattgattaaacttttgaccacatgattgagctaaattttcagcatccctccccttcttggaggttaagcctcaagttccagttctccaatcacttggttggtttctctggcaaccagcctccatcctgaaaccacttgagggaccccttccatgagccacttcattagcataacaaggaatttctgatttctgtcactaagagtttttgaagctctatgtcaggaaccatggacaaagaccaaatagctactttgtattatttcaatagctatcaactagagaatttcccttgccattctccatttgtggatccagatcctctttcctggtttatcttctcagttgatggatggtgtcctttattacagtttgggaaagggagcatagcaggattttgaagaccttatttttacccttacacttgatgaatagtgtggctaggaataagttgaatactttttcttagaattttgttgtttcttttcttattccaatgttccagttcccaatagctttgttttgctctctgaatgtttcttgttggaagtatctgatttttgttagtatttttaaagcaatgccgttgctctgttatagtactgaagttgtcctcgtcttcctccttcttcttctttcttcctccccgtgcccctttcccttccccttcttctttctttcttctgcttctgctgctgcttcattttcttcctgctccttgatccttctacttcttgcttttgctttttatggaatttttcttctacttcctgtattgtctgcatcctcaaagtcccttatctgttgtttattttggtctctatttgtcatattagagcctttctcatgatgataggtgatctttggtagaagctgtgtgtgtgtagtgtgtgtgtatgtgtgtgtatgtgtgtgtgtggtgtgtgcaggcagggggttcccatatgtctgtatggtagtggtggtgatgttggagaagtgggcttcatcatagcatgatttggatgggaacgtattttggggaccttaatatgattaggtcttttctcttcattggatcacatttcccagagaaaatttttctagtatgctacctgggcagtatgtgcctggcagtcagagctctggaaaccaaaacaagggaggggctgggggtcatgcattcttaacccacctctgttgtcagtatgcatctgtgctcttgctttacctatgctcatcatacagagtcctcctcatatttcctcttctgagaataaaatgctaatattatgccatggccaagagaggcagttgccacttgtgcattgtggttcttaaaatgaatatgcaacagagcctatgaagaacttttaaaatatgagtgttgaggtatgtatgtgaaaatagcagaataatggcctcaaaaattatttcctccataaaatcagaaagaagaaggaaactgccaacatttgccaaaagtaagtttttcaaaactttagaaataaactaagaggagaccaaaagctagcagcaatctggggagcatttattttttataaaaataggccgaatcttggtaagaacagtgacttttgtgacattttaacctgccctatttccttctcccatctccagctccctggtagccttgaatctgcaattcaggctgcaatcatgatgaaaccatcagcctttctgtcaccaaagtggagagaacagagttaaagctcctcagagtctcactgttggagaattgtcagtatttggtctgtctggtggttcagtagaagaccccacttgcaagactatttttacttgaccaaatgcagagctttcccagtctagaaagccttttccctgggttgttgggttgaaaatttagaagtaattgcttaaccttggggctgcctgaggcagtggatatcaactgaggaagataataagctataaaaagatgaaaaggaaaggctggggaattcgatgtccacaagttctttgaaaagctccaaaaaacacatgtaaggctgtgcacatgctcaggaaaaatctgagaaggccttagactctcacctctgactgaccttgagactgtgcacaggcaggaagtgaaggctaaagcagggctgtcagctgcctggctgtgtgcggaaggtgtgccccagcacacaacacagcccactgcaaacactgggggcagagctgtcagctgcctggctgtgtgtggaaggtgtgtcacagcacacagacatagcccactgcaaacactggggacagagctgtcagttgcctggctgtgtgtggaaggtgtgccccagcacacaacacagcccactgcgaacactgggggcagagctgtcagctgcctggctgtgtgtggaaggtgtgccccggcacacaacatagcccactgcaaacactggggacagagctgtcagctgcctggctgtgccgaagatgtgctccagcacacagatgcagcccactgccaacactggggattcatggatgccaagcattgaaggaaatctcagtttcctaaatagctggcaactcatataacaaaggaaagactttagtgagtatacacaacaaaagatacagactttacagaattagttgagaaaagttactgaataaacaaatagcagcaacaacaaacctagggttggaggatatactttccagatttttcacattatagtatttttttttttttttgagatggagtctcactctgtcgcccaggctggagtgcggtggcgcgatgtccactcactgcaacctccacctcctgggttcaagccattcttctgcctcagcctcccaagtagctgggattacaggcatgtgccaccacgcccagctaatttttgtatttttagtagagacagggtttcaccatgttggccaggatggtctcgatctcttgacctcatgatatgcctgcctcggcctcccaaagtactgggattacaggcatgagccaccatgcccagccacattgtagtatttaaaatgtccaattttcaaaaaatatatgtatgagacatgcagtgaaaatttaaaaagcagatggcatatacagagggaaaaacaaaacagagtcaataggaattgtcctaagaaagcccagatgttgagtttactagcaaaacactttaaaccagttattttatatatgttcaatgcagtaaacactgtctaaaacactaaaggaaagtataagaatatctcaccaaataaataatgccagtaaagatgcatagacataaaaaatttgattctggagttaaaaattccaataatgaaaatgaaatattaactaatgagtttcaataaaggattcgaacaggtggaagaaagaaggaacttaaagacggatcaactgagtttatcccatctgaataactgagaaaaaaaatggggaaaaatgaactaagcatcagaaacctgtgagaaaacaatcatagcaacatacgcaaaagagttatcctagaaggaaagaggaaagaaaggggcagaaagaatacttgaagccaaagggagtaaaagcttcccaaattgggtgaaaaacattgatgtacacatccgtaaagcttaacaaactacaggaaggataaaaccaaagatccacacctagatacatcataatcaaactgttgaaagacaaagagggaatcttgaaagcagcaggagagaaccaactcatcacatgcaaagtagccttaatcagatgaacagctgatttctcaacagaaaccatggaagatagaaagcagtggaaaaggatattttcaaagtgctggaagaaaagactttaagaattctatacccagtaaaaatatctttcaaaatgaaggagcaattaatgcattttccaattttagagaagctgagacaatccactgctggaaaattttccctgcaagaaaatactgaagagtactttaggtgaaatgaaaggagggtaattgggatctataaagagataaagaatatcagtaagtaactacctaggtaaacataaaagacactgtaaatatattttgtgttcataactctttttttctcctctctgatttgagatgcaactgcataaagcaataattataagtatgtgttgatatgcatacagtgtatataaatgtaatttttaatgcaacaacaacacagaggaggagaaagcaaagttatacagggggaaagtttttgtacactattgctttaagttagtatcaatccagacaagattgttagaagtcaagatgttaattgtaattcccgggaaaaacagctttacaagaagtaagtgaagtgacaaggaaatgaaaatggtacagtggagaacatctgcttaacaaattagaaggcagtagggaaggattgggggaagcacacaaggcatgtagaaaatcataaaaagcacctaagacatatagaaaatagcaaactgggcacagtggttcacacctgtattttaagccctttgggaggctgagacaggaggattgcttgaggcctatcgttggaggctagcctgggttacagagtgaggccctatctctacaaaaaaaagaaaaattaggtaggcatggtgactcacacctgtagtcctagctactcaggaggttgaggtgggaggattgcttgagtgcatgagtttgaggctacagtgaactgtgattacactgcactctagcctgggtaacagagtgagaccctgaggaaggaaggagcaacctgttagctgtaaattctactttatcagattgcacatggaagtaggtggattagacactccaatgaaaatacagagattgacagaataaattaataatttggctgtatatgcaagagacacattttagattcaaaggcacaaataggttgaaaataaatagatgcaaaaagataataccatgcaaacagtagtgaagctagagctacagtggctataccaatatcagacaaaatagacttcaaagcattactacatctctacatggtggtgggcgcctgtaatcccagctattcgggaggctgaggcaggagaattgcttgaacccaggaggcagaggttgcagtgagccgagatcgcaccactgcactccagcctgggtggcagagcaagactccatctcggggaaaaaaaaaaagaaaaaagtgttactacagactaaaaagagcatttcattgtaataaaaagtaaactggtcaggaatatatcacaattataaatacatatgacgtatcaatggggccctcaaatacatgaagcaaaaagagacagaattaaaggggagtaatagacaattcaacaaaaatagttgaagacttcggtacccctctttcaataatgatagaaacactagacagttaaaaaataaatggaagacttgaatggctttcgtctgctagctaatggacaccttttttgtgatacccttgtttcttgtgtataattttaaaacaactacataaagcaataattaaaatctgactgacattagacttaataatagagttaataaccattaggcttaaattagacctaatagacacatctataggacactccacagaaaatgaaaagacaactcacagaatgtgagataatatatgaaataatatatttcctaagggtcaagtatccagcatatgttaaagaaactcttacaactcaacaaaaatacaacctaatttaagaaagatcaaaggatatttatccaatgaaatactaaatgagtagacatttattcagtgcaatagtcaaagccactgaggctgggcctgatggccgaaacctgtagtcccagcattttgggaggctgaggcaggaggatcacttgaggccaggagttggagaccagcctgggcaacccatcaagacccaattgctacaaaaaaatttaaaaattagctgggtgcagtagtgaatggctgtagtcccaactcctcaggaggctgaggcaggaggatcacttgagcacaggaggtcgaggctgcagtgagctatgattataccactgcactccagcctgggtgatggaccaaaaccccatctcagaaaacaaaaacaaaaaactaagaaaactccactgaattctgtactttaaaaagataattttatcatacattaattatggctcattttttaagtataaatgcttgtgtccaaaccttcttatatcttgaattgttcagtgtgaaaagagatctaggttgctttttttttaaaacaaagcttcctgaattgtctgttgtgaatattgtgttagcaaacatagattttgaaaatcagcgaaacaccagaacttgaaacgcactctgggcacttaacttgaaagtactacatatgctatttttataattattttttatctgattttccccccgcccactagatttatctcaattgatgaagcatttattgtggcttcttaatagatgtctatttagaagaattataaacctttttaaaaaataagccagctttattgaagctgtaattgacatacaaaaactatatagtttaagtatacaggttgataggttgagacaagtttgtacactcatgaaaccattccgacaatataaagaacatttccatcatttgtaataggctgcgttttgttttgttttgttttttgcccctctgcagttcctcccttacacctcagcttcctctaacctccaggcaaccactaatctgatttgtcactatggattattttgctcactatttaattggattttttaaatgttgaattttgagagttctttatatattccagagataaaagtactttgtcagatatgtggactctaaatgtaagagtggtttccaatactcttaacaaggtattttccagcaaaaaaaaagtttttaattttcatacagtctaattttatttttcttctacagctcatgtttttagtgtcatgtccaagaacatttcactaagcccaggaccctgaagattttttcctatgttttcttaaaaaggtttatagtttaacattcacatttaagtctgcaatctattttgagttttttttgtgtgtgtgaacatgtgaggtttagttcctttttttttttttttttttttttttttttttttttgagacggagtcttgctctgtcgcccaggctggagtgcagtggcacgatcttggctcactgcaaactctgcctcgcggattcacgccattctcctgcctcagcctcccgagtagctgggactacaggcacccactaccatgcccagctaattttgttgtatttttagtagagatagggtttcaccgtgttagccaggatggtcttgatctcctgacttcatgatccgcccatctcagcctcccaaagtgctgggattacaggcatgagccaccgtgcctggcctagttcctttttttatatcgatgtccgattgctgcagccccatttgttgaaaagattgccctttattatccattgaattgcttttgcacatctgtcataattattaggctccacttcaggaggtctatttctagagtctttattctgtttcatttatctatgtattaatccctcaactaataccacacagcctagatcactgtaaatcttcaaatctggtgggatgattgcttatattccttctctttcaaagttgtttcagctactcttttccttttgtctttccatatacattttagaactatcgtatgtatatcaacaaatatattacagggattttgatatgattacattaaacctcgataccaatttgaggaatgttagcatatttattatattatttcagtttgtgaatatgtctgtttatttcttctttgattcctgtcattggtgtttgtaattttcaatatacaagtcaagtacacacttcgttagatttacacctaagccatttgatatggattgtcccctccagatctcatgttgaaatgtgatccccagtattggaggtggggcctggtgggaggtgtttggatgattggagcagatccctcatgaatggcttgctaccctccccagtataatgagtttatacaagagctggttgttcaaaagagcctggcacctcctcctctctctcttgctccctctttcaccacgtgacacacctgctccccttcaccttccaccatgattataagcttcctgaggcttcaccagaaacagatgctggcactatgcttctcgtacagcctgcagaactgtgagccaaataagcctctttttttttttttctcaataagtcagtctcaggtattcctttatagcagcacaaaatggactaacagtaaattggtactgaggagtggggtgttgctataaaagatacttgaaaatgaggaattaattttggaactgggtatgggcagaggttggaagagtttggaggacttagaagacaggaagattagggaaagtttggaacttcttagagactggttaaatggttgtgaccagaatgctgatggcaatatggacagtgaaaaccaggctgatgaagtctcagatagaaatgaggaatttattaaaaacgagtaagggcactcctgttacaccctagcagataactaggctgcattgtattcatgttctagggatttatggaaagttgaacttaagagtgataacctagggcatctggcaaaggacatttctaagcagcaaagcatttaagaggtgacatggctgcttctaacagcctactgtcagatgcaggagcgaagaaatgactcagagtttgaagttacatttaaaaggggagcagagtgtaaaagttagaaaatttgcagcctggctgtgtgaaagaaaaagcattttcaggagaggacaataagcagattgtgtcaggagaggactacaagcactagtggagcaacttctcccaaaagagatttgcatgactaaaagggaggcaagcactaatagccaagacaatggggaaaaggccttgaaggggtctcagaaatctttgggacagaagttcccatcacaggtccagaggcctgggaggaaagactggtttctgaggccagagctgaggcactgctgccctgcacagccttaggacactgcatccgtgatcctggaagctctggctccagtcatggcacagagggctccaggtacagcttgagccactgcttcagagaacataagccgtaagctttggtggtaccatgtggtactaagtctgcaggtgcacagaatgcaaaattgaaggaagcttggcagcttttacctagctttcagaggatgtatggaaaacactgggtgcccaggtggaagcctattgcaggggtggagctaccatggagggcgtctaatagggtagtgctgaggggaaagatggggttggagccctcacatggagtccccaccaggtcactgcctactggagctgtaggaagggggcaaccatccgccagacccatgaatggtagagccactgtcagcttgcaccctgagcccagcaaagctgcaggcagtcaactccaacttgtgtgagcagccacagagagggcacactctccaaagccacagggtcagagctttccaaggccttgggagctcacctctcacaacagtgtacccaggatgcgggacatggagtcaaaggaggttatattggagcttgaaggtttaatgttggccctgctgggtttcagacttgtgtgtggcctattgcccctttcttttggctgatttctccctttaggaatgggaatgtttaccaaatgcctgtaccaccattgtttcttgaaagcaaataacttgtttgtgatctaacaggctcataggtcaaagaaatttgccttgagccttagatgaaactttggacttttgattgagttaatgctggaataagttaagacatttggggactatttggaagggatgattatattttgtaataggagaaggacaagagatttaggggaccaagtgcagaatgatatggtttgggtatttgttccttctaaatctcatgttgaaatgtgatcctcaatattggaggcaggggctggtggaaggtgtttgggtcgtggggatggatccctcatgaatggcttgctgctctccccactgtaataagttcatgcaagaactgggtgtttaaaagaggctagcaccacttgccctctatcttgctccctcttttgccatatgacacacctgctccccttttgccttccacaatgattttaagcttcctgaggcttcaccagaagcagatgctggcaccatgcttcttgggcaacctgcagaaccagaaaccaaataaatctctttcctttataaattacccagtctcaggtattcctttttaccaatgcaaaagggactaatacattggtcttccttcattgttttccttcttcctgttcccattttctcccttccttcattgtcctccttcttcctgttcccattttctcccttccttctttccttccttcttattgttaaaaattgtaaatgttaatgtatatttaattttgatgtccatatgctcattgctggtgtatataaatcaagttgatttttggtatgttaattttgtatcctgcagctttgctaaactcacttattctgtttttgttttgtttttgtggattcttcgggattttctatgcagacaattatgtcttctgcaaacagccagtgttatttctttcctttccatctgtatgtgtttcattgccttttcttgaacttactgcactggctaaaacttctaacagtataacataacataacatagtgttagaagttttagccagtgcaataagttcaagaaaatagaataaaagtagagagagcaaacgtctttgccttgtttcctattttaagaagaaattattgattattttactactaaatataactgtagctataactgttttgtaaatgctgtttatcaagttgaggaagtttgcctttattccgacttttttgagttttataatgaataggtcttgaatttcgtcagatggttttttctgcggctcttgatatgaatcacattattaatattattattattattattattattattatttttgagacagagtctccctcttgttgcccaggctggagtgcagtggcatgatctcggctcactgcaacctccgcctcctgggttcaagtgattctcaggctcccgagtagttgggattacaggcatccgccaccacgcccagctaattttttgtagtttcattagagatgaggtttcaccatgtcggccagcctagtcttgaactcctgacctcaggtgatccacccacctcggcctcccaaagtgctaggattacaggcatgtgccaccgcggctggccagaatcacattatttgatatgaatttttttgtgtagtttttcttcttttgccttttctatttaagttttatattgattgattttcaaatattaaaccagccttaaatccctggaataaaccctggtttggtcatggaacataatttttttgtatatattgctgaattcaatgtgctaacacttattatggatttttgtgtctatgagagatattcatctatattttcttttttatactttctttgtttctgtaagcagggtaatactggcttaataaatgaattgagaagtgtttcctctttcaaattgtggaagcaatggtgtagaattggtgttaaaattattctttaaacatttgatacagtgaaatcgtctgggcttagagactttatttttaagagttttaaaattacaatttcagcatctttaatgttataggacttttaaaattatttattttgtattaggtgagttgtaatcatttgtcttttttgagggatttattcatttcgtctaaatcgtccaatttatgagtgtaaaattcttcatagtactttcttattatcctttgatatctgcaggatctgcattcatatcctctattttagtcctcatgctgcttatttgaatcttctctcttttttctttattagtctcgctaaaggtttttcaatgttactgttctttttagagaaccagctctttgtatcattgattttctctattgcttgctttcaatatcattgatttctgctcttacctctattttttccttcatccttcttgctctctgggaaatttttttttctctttttgtaggttcttcagataggagcttatattattttttgagtcttttccttttttctcatatatgcatttattattgtaaatttccttcagcattgcttgctttctatctcacaaattttaatatgttgtattttcatattcaaaatatatttttaaaaattatcttgattctttctttttgacctacagattacttagaatgtgtgttttttcaatattttagcctttggatattttcctattattcttccattgttaatttgattccaaattatactttgtgttatttcagttattctacatttttgagttttatggtccagagtatggcacattttggtatgtactccatggccacgtgaaaagagtattttctgcttttgttcattggggtgttgtgtaaattttagttatatcttgttggttgatattgttaagtttgtctgtatccttgctgattttctgtctctttctcttttaaattgtggagagacaaagtataaacatctccagctataattgtggatgcttctgtttctcctttcaattttgtaagttttgtcatctatgtgttttgaagtttgatgacacacaattaagattgctgtgttttcttggcagattggcctgtttatcgtcagatattgtctctccctatctatggtaattttctttgctctgaatgctttatttgatattatatcaggccacaacagatttatttagattaaggtttacatgctgtattttgttctattgttttattttcaaatcgtgtgtattgttttatttgatataagtttcttgtagacagcttatagtttggtcatgcttttttgttgctgtttttagtagattttatttttagagcagttttaggtttacaacaaaattgaacaaaagtacaaagatttcccacatatcctgtgtcaccccacatgcataatctctctcattattaacatccctgaccagagtggtacattgttacgattgacaaacctacactgacacatcattgtcacccaaaattcatagtttacattagtgtttgttcttggtgttgtacattctgtaggttagggtaaatgtataatgacctgtatctaccattataatatcattcagaatagtttcactgccccccaagtcttctctgctccacctagtcatcccttgctccacccaactcttgaaaacccttggtctttttatagtatctataattttaccttttccagaatgtcagctctgggaatgtatggtcccacagttgggagcatacagaatgtagccttttcagatttgacttctttcacatagtaatatgcatttaaagttcctccatgtctttttatggcttgatagctctttttttttttagtgttgaataataatccattgtccagatgtaccacagattacccatttacctactgaatgacattttggttgcttccagttttgggcaattatgaataaagcttctataaacatctgtgtataggtattgtgtggacatatgttttcaaatcctttgggtaaataccaaagagggcaattgctggattaaatggtaagagtatgtttagttttgtaagaaaatcctagactgtcattccaagtgcctgtaccattttctgttctcaccagcaataaatgagaattcctgtttctgtttgtccttgccagcatttggtgttgccagtgttctggattgtggccatttcaataaatgtgtagtggtatctcattgttgttttactctgcatttccctgatgacatatgatgtggaacatattttcatatgttgatctgtatgtcttctttggtgaagtatcagttaagatctgtcttagttcatttagtgttcctataaaggaatacctgaggctgggtaatttataaagcaatgagttttatttggcttacagttctacaggctgtggaagtatggcaccatcatctgcttctgatgagggcttcagtctgcttctactcatagcagaaggtgaaggaggaggagcatgtgtagagatcacatgataagagaggaagcaagagagaaagagaaagaggtgacaggctctttttaacaactagcactcactgctcttatgggaactaaaacagtggtaactcattaccaggaggatagtaccaagccattcatgagggatttgccccgtgacccaaacacttccccttaggtgccacctccagtgttggggatcaattttccatatgagatttggagggatcagacaaactatagcaaggtctttggcctatttttaaattgggttgcttgttttctttttgttgaattttaagcactgtttgatgtttttgtataacagtcctttatctgatttgtctctttcaattactttctcccattctgtgacttggcttctcattatcttgaaattttcttttgcagaggagaagtttttaattttaatgaagtccagtctatcaattctttctttcgtagatcatcctttggtgttacttctaaaaagtcatcaccataccaaagtcatgtaggttttctcttgtgttatcttctagttttatagttttgcattttacatttaggtctgtgatccattttgagttaatttttgtgaaggatgtaaggttgtatctacatttattttttcgtatgtggatgtgagttatttcagcatcatgtcttttaaagactattgggacctgtttttctagtctctgccaacgtgtattaaattactttatttaaaactagaaaacctagaagaaatggttacattcctgaacacatacaccctcccaagactgaacctggatacagtcaaatccctgaatagaccaatgacaagttctgaaattgaggcagtaataaaagcctaccaaccaaaaaaaaaaaaaaaaagcccaggaccagatggatttatagcttaattctaccagaggtacaaagaggacctggtaccatttcttctgaaactattccaaacaattaaaaaggagggactccaccctaactcatttcatgaggccagcatcatcctgataccaaaacctgtcagagatacaacaaaaaaagaaaacttcaggccaatatccctgatgaacttcgatgcaaaaaccctcaataaaatactggcaaaccaaatccagcagcacatcacaaagcttatccaccatgatcaagtcagattcatccctgggatgcaaggttggttcaacataggaaaatcaataaatgtagttcgtcacatacacagaactaaagacaaaagccacttcattatctcgataaatgcagaaaaggactttgataaaattaaacatcccttcatgttaaaaactctcaataaactaggtattgatgggacatacctcaaaataataagagccatttatggcagacccacagccaatatcatactgaatgggcaaaagctggaaacattccccatgaaaaccagcacaagacaagaatgccctctcccaccactcccattcaacatagtattggaaattctggccagggaaatcaggcaagagaaagaagtagagggtattcaaataggaagagaggaagtcaaattgtctctgtttgcagatgatatgatcctatatctagaaaaccccgttgtctcagcttcaaatctccttaagctgataagaaacttcagcaaaatctcaggacaggaaatcaatatgcaagagtcacaaacatttctatataacaacagacagagagccaaatcatgaatgaactcccattcacaattgctacaaagcaaataaaatacctaggaatacagctaacaagggaagtgaaggacctcttcaaggagaactacaaaccactgctcaaggaaatcagagaggatacaaacaaatggaaaagcattctatgctcatggataggaaaaatcaatatcatgaaaatggccatactgcccaaagtagacagatttaatgctattcccattaaattaccattgacattcttcacaaaattagaaaaaaaaaaactactttaaaattcatattgaaccaaaaaagggcccttacagccaaggcaattccaagcaaaaaagaacaaagctggagcagcatcactctacccaacttcaaactatactacagtgctacagtaaccaaaacaggatggtactggcacaaaaacagacacatagaccaatggaacagaatagagaattcagaaataagaccacacatctaaaaccatctgatcttctacatacctgacaaaaacaagcaatggggaaaggatttcctatttaataaatggtgctaggagaactggctagccatatgcagaaaattgaaactggatcccttccttacaccatatacaaatattaactcagggtggattaaagacttaaatgtaaaaccctaaaatataaaaacctagaagaaaatgtaggcactatcattcaggacgtaggcatgggcaaagatttcatgttgaaaacgtcaaaatcaattgcaacaaaaacaaaaattaacaaatgggatctaactaaagagcttctgcacagcaaaagaaactgtcatcacagtgaacagacagcctatagaatgtgagaaaatttttacaatctgtccatctgacaaaggtctaatatccagaatctacaatgaactaaacaaatttacaagaaaaacacaaccccattaaaaaaatgggcgaaaggcaagaacagacacttctcaaaagaagacatttatgtgggcaacaaacatatgaaaaaaaagctccacatcacgaatcattagagaaatgcaagtcaaaaccacaatgagataccaactcatgccagtcagaatggcgattattaaaaagtcaagaaacaacagatgctggcagggctgtggagaaataggaatgcttgtattctgttggtgggaatgtaaattagttcaaccattgtggaagacagtgtggcaattcctcaaagacctagaaccagaaataccatttgactcagccgtcccattactgggtatatatccaaaggaatataaatcattctattacaaagatacatgcatgtgtatgttcattgtagcactattcacaatagcaaagacatggaatcaacccaaattctcatcaatgatagactaaagaaatgtggtacatatacaccatggaatactacagagccataaaaagaaatgagatcatgtcctctacaggtacatggatgaagctggaagccattattctcagcaaactaatgcaggaacagaaaagcaaacactgcatattctcataagtgggagctgaacaatgagaacacatggacatggggtaaagcagggaacaacacacaccagggcctgtcgggtggggtcctggcagtgggagagcatcaggaaaaatagcaaatgcatgctgggattaatacctaggtgatgggttgataggtgcagcaaaccaccatggcacatgtttacctgtgtaacaaacctgcacatgtatcccgaaacttaaaatataaaattaaatttgaaaaataaaaataaataaattactgtacttagagtatttacatttaatgtaattattggtatgttaggggcttatgtgtgccattttatttctgtattttgtttatcttttttatattttacctgctttcctataggctatttgaacatttttaagaattccatttgatttattcatagtgtgtcccagtggaactctttgtgtatatataaattattccaatgagtaatactctattgtttgaatattagtcgtttttctaggtattatattatttatgaatagcttattcctgtctactaatgttattttaccagtttgcatgcagcatagaaactttacctccctttatcctctcctgtagttacctttactattttctccacatacattaaaaccatctcagacagttttatactttttccttcaaccaacaaacataacttagaatactcaacaagagaaaaaaagttccattatatttacccatatttttacttgccatatttttccctgctttctctccactcttccttcttttaatgtttcctttcaatctattgaactttagctattcttctgaaggtagatgtggtggcaacacaatcttttagttgcctcagtctgagaatttcttcatttttctttcatttttgaccaatatatttcactgtatataggattctgaggtgatctttttttcagcatttgaaaaggttgtttttcttcattctgaactctgtggtttccaatgaataatactttgtcatttgaattgtttttgcagtataggtaatgtgtcatttttctttctctgtttttaaggtgtttgtgtggtccttaatttttagaaatttgactgtgatgtgtcgtggtggagatttctttggatttatcttgtttggggtttgttcatttctttaatctatagatctgtgtcttttatcaaatttgtgaagtgttggtcattattcatgtactttttcaactccaccttcttcttttatctaggactccaattatatgattattagattttttttgtagtcccataagtctgacttttttttcagtttattttacctttgtttttcaaattgagtaatttctattctatctttgtgttcacaatctccacctgtaattcttagtaaagcaggttatatgtaagatgagaatgttttagagaacaactcagcatgaaaataatcagatcatatttgtggcaatacaggatgtaaaatatggggatcatagaatagaacttaacagttctttcaacagttggataatgcaattagtacaactttatgcaatgtcttctttccactgtatatcttatttttaatatgattattttgaaaaaacatactaattatataatattccattttatgtataagcaatgatgtattgctgggcagttaactttgttgataatattgcaagccctataaataacattataatgaacatctttgggtttctatttttgttaatgatcactgttttttagtataatttcttaaatgtgaaattagtagctcaggctgggcatgatggctcatgcctgtaataccaacactttgggaggccgagacaggtggatcactcgtggtcaggagttcaagaccagcctggccaacatgatgaaacactgtctcctactaaaaatacaaaaatcagcctcgtgtggtggtgcacacctgtagtcccagctacttgggagaatctttcatgataacctgactttctataaaatataaattaggacaaatgtattccttggtgctatggtttaaatgtgtcccccaaagttcatatgttgggatcttaattcctaatgcaacagtactgggaagtgggcctaataggaggtgattagctaataatgattaatattgttattgtaggagtgagtattgtgagagggggagataaattatctcaagagtggatgtgttaaaaaagtgagtttggtcccctcttgctctctctcgagtactctctagcccttctgtcttccatcatgggatgttgtagcaagaagccccattgccagatgccagcactttgaaattggacttcccagcctccagaactgtgagaaataaatttctttataaattactcccttcatgatattctgttacagcaacacaaaacagaccaagacactttatcaaattgcaaagaaacattgttgttctaggttataataaatgtaaaaactagtgcaaatttattttgggctacatgtgaagggatgagataaggagggtggatggtgtgggacagaaattcaactgttaactattatatagattcaaacttggacgtcatctacacatagcaatttattcctagccagttcagggtttataatgaaaaaatatttccctgacatattaagtggctcatatataacaaaaggtcatttatgaaggaaggaattactttggaaatttatgcaaactatttaatcacttaaattatgaaaaagttccaacgcaatttggttcctgattttgtgataggaacatttttcttggtaattggtgtagtggcctcatgtcaggagtcacttcattctccttttcagaagaagaaaagggtttatgaatggtctgtatttgattttttagcacctcactattcatcagtataagccctagattagatgggcaatggaattttgggctgaagaagggagaggtatagttttccttgtgttaaaactctgtttgattaattagaatgaactgccaaggtgtttctggacaccagtaatttattatcttcctacaagtctataagagaaggattagagcctaaaagtctgtatggaactcgctatttataaattttacagaaaaacaaacatgttggaaaactgcaagtttaatcagattctacaggacttcttagaatccttgtgacagcaatatgaactaagaattggtaggaggggttatagttctttctgtttaatgtctgtaatttacatagggctctcttagaccatagatttagggtgaccccagcctggtttcacaaggtaggacttccattgaattctctctcaccagtgtgttcctcgtttggagttcagcactggggactgactgggcggcaatgtgcatgagcacatacagtctcagaacatgcactttgggcaaagagcagagcccctttaggtcagggttggatttaccgtggtggctccagtagaggactgaagctttggcatatcatgttcaatgttccttcctctccatcagatatttttaataaatgtgcaagtctttaataaatgtgaatcaccagtggtggacattttgtccaagaattgtcctgaagaggaagacagtttggaccagctgccctgggaaactcctcaggctactttactcgagtgcagcctcgctgactgctcatgctagtgcattagaaggtggccacgaggacaggctggcgctgcctgcacggcctgcactcatacctatgctcatcggctgacctctgactcttttttttttttttttgagacggaattctgctcttgtggcccaggctggagtgtaacggcacgatcacagctcactgcaacctccgcgtcctgggttcaagtaattctcctgcctcagcctcctgagtagctgggattacaggcacccaccaccacgctcagtgaatttttgtatttttagtagagctagggtctcagcatgttggccaggcctcgaactcctgacctcaggtgatccacctgccttagcctcccaaagtgctgggattacaggtgggagccactgcacccggcctccccctaattcttatatttcagcaacatgtccctgtaggtcacttctagtagtctttgctatttaaataagcttaggagcatctgcaaacttagaaagtttcctgcctttgagataatttataaaaatatcaatgttgattctggcagaaaccccccatgtaggccctttatcccaattaatgtttttcaaacattagagtgcctgacattgtgatagatcattagccgtctctgctactttatatattttctgtatctttatccttatgcatacaaagaaacttagcaccatattccattcattctaagatgcacattagtttcacattttaacttttttatttaaaatcgggcatgtcttacagttgaatagcatcttagatttgatgacatgtgaaactagaataaatgcttagaggattaacagtggaattggaattatcccttgagtgtatgttaaaaataacctgaaaagagtttgtatttaaaagtattttcagagtttcaattatgctgactccaatttttgtatcccattcttctgaattcagtttctccttccaggaggacacctgatagtaattactccaatgaagtagtgtcagtaatgacattgtctttgtttatctgaaaaacgtttttcttttaactttactcttggacggcagtgtagctggtcttagattccaaagttgaagtccataattactttccataatttgaacatgttacttcattgattcctggctgctcttattgtggcttgccatctgctccctggccagtcgttgttaccctgtggataaactgtttgattctgtacttttaagatattctttttcatattctatcgttttactacaatgtgacttagttaattttaaaattataaataaacatattataaataaactcccttgtaatatcttcaagttttctttaaagataaacacttttggccaggcacggtggctcacgcctgtaatcccagcactttgggaggctgaggcgggcagatcatgaggtcaggagatcgggaccatcctggctaacatggtgaaaccccgtctctactaaaaatacaaaaaattagctgggcctggtggcaggcgcctgtagtcccagctactcgggaggctgaagcaggagaatggcgtgaaccctggaggcggaggttgcagtgagccaagattgcaccactgcactcagcctgggtgacagagcgagactccatctcaaaaaaaaaaaaaaaaaaaaaaagataaacacttttatttttcaagtttactttaacagctatctttaaagaaaacttgaaggtactgcagggagtttccctggaggccacacagtttcccctgtgagtatcctcttgcatcagtatgatgctgtttgttacaattagtaattggatattcatagatattttaaactgaggtccgtactttattcacattttattggctttttaaatcccatttcctgtttctgttccacgatcccatccaggagtccatgtagcatttagtccttgtgtctttttaggctcctcttcattgtaacagtttttcagcctttccttgtttctgatgatctcgacagttttgagtagggcactggtcagatattttgtaacatgtctcttcattgggatttgttggatgtttttatccaagttagaatggagtaatgtgttttggggtagacagacagcagagtattatatgttatcatatcatatccagggtgcataatatcaatatgacttactgttgctgtgggccttaatcaaatggcttaaaatggtattcgtcaggtccctcgactgcaaagttactctttttcccctatttatatactgtactctttggaaggaagtcactatgcacagcccaggaagtcactatgcacagcccaaattagggagtggaaagtagtgtttcacctccatgaaggcaaagtgtctacataaattgaaattcttcttcatggagagtttgcctccttcaccccatttatttatttaatcatttatttatgttagtgtggactcagcagtatttattttatattttggagtgtaatccagtattaccttattttgttgttcaaattgtttactgttttttaccactaggtacttgttaaatttgctgcagtatccctctggcttaacagcactggtgttattttatttttttcactcattttccttctttctggctctacagtatgttccaggttcatctggtatatttcctgcccaacacctagaatcagccctttctccagaaatcctggttccttgtattggtgaatgattagaaagcaaggtttgggtgctaggtgggttcattgccattggggcgtcatcatttctaggccctttctgacagagcaaagagttatatgtgtatatagtagttcatatatacagaaatatctgtaagtatttctgtatgtaaccgtatgtatccttattaagctaaacgtgaattcatgcttaagtctccaactctcactctaaagtgagaaaactgatttctacacatggcatccatttacttaactgttcgattgcaatatacatgtacagtagtttcagaattggtaacttacaactctgtgaggagcaacttcatcaagtagagtgcaatgctgatacacagttccttgcagaatacacccagtttcaaagttacttagaccagcacctttttctcccagtcacgtcagtaaggtcgttttatacttttgtaatgcatttgaatccttttgttacattttgtattccattctggatcaccgaatctcctaagtatttgttttgtattttgcattcattttgggttactctttgtattataaagttctatgagttttgacaatgcttaatgtcttgtattcaccattacaatatgatacagaattctctgccctagaagtactctgtgctccatttgtctactcctaacccccaccactggcaaccactgataaatttacagtctctaaagttttgccttttgtagaatgtctttttattggaatgatacaatatgtagccttttcggcctggcttctttcacttagcactgtgtatttaagaatcacctatatctttcatggcttgatagctcatttcattttatacttgaataatattccattgtgtggatgtgccatggtttgtttttccattcacctgttataagacatcctgattgcatccagtttttgtgattatgcattaggctgctataaacatgtgcaggttttctgtagatatgtgtttttgaatcattgggtaaatatctaggaatatagttgttgtatcgtatggtaacactaggtttagttttgtaagaaaccgccaaatcgtcttccaaagtggtggtaccattttgcattcttaccagcaatgaacgagccttcctgttgctccccatcctcccagcaattggtaatgtgaacttttcagattttagcctatccgataggtatatggtggtattgcattgttataatttacatgtccatgataacatgatgtgaagcatcttttaatatgtttatttgttatctgtacatcttctttggtgagttgcctgttcatatcatttggccattttttagttaggttgtttgttaatgtattgctggtttctttcctatattttgaatataagttctttatcagagatgtattttgtaaaattgtatcccagtctgtagtttttcttttcattcttgtaacagtatcttccatagagcagtttttaattttaataaagtccaacttactaattttttctttgcatggatcatcatgcctttgctgttgtatgaaaaaccataatcaccaaacccaaagtcacgtatatttaatcctgtcttttcttctagtattagaattttatattttacatctaggcttatgatccattttgatttaatttctgtgataagaataagatctatgttgaattttttagacatttattttacttggtgtctactgagcttcttggatctatgatttgtgtctgtcaatggtgttgggaagttctcagccattattctttcaactattctttctgctctgctctcgcttttggtgattcaactatatatgtgttatacctttcaaaattgttccacaatttttggataatctgttttttttttctttttgcaattcagttttggaagtttctgttgacacattatccagctcactgattccttgcttggctgtgtccaggctcctcatgaggccatcaaacgctttctttcttttttcttttgaaactttacaaggcttaaatttcatttaacttacatttttgacacaacatgttcaaattgcatacaggcattctttatttctgttacactggttttgatttctagtatttccttgcaattctttctgagagtttctgctgatgttacccaactgcttttgcatgttgtttatttttcctttagcacctttagcatatttatcacattattttaaatttcttatgtgataatttcaacatttgtatcatatctaagtcctgttctgatgtttgctttgtctctgcagactgttttttcttgtcttttaattgccttgtaatttttctgtaataaagcagaaatggtcatgacattatgaatttagataagtagctttttagtgtgcgaattcatgtgacaggtagtagttgggctttatttgatgtttgctatagctttaactgccagagccttcaggttcttctagtgttcctgtttttgtcttccctcttgatgtctgtcttccttaattaagtactctttctcagagaatctacagctttttggactgtagttcacagtagttatactggacccctgttggtggggtggtaggtggggatgaggggaagaagtgttctgtaatcctatgttacatggtagcattgtagtaggcctgtgtgtctgggctctgaccttcacaagtgtttctctagtggtatagcagtggtatagctttttcccttcttaggtaagacagaaaggctacaggctgctggagtgggaccagtgtaatttccctagcagggataagctctgagaaaccctggagagtaggcttttttgtggagaaggctctgggtgacctgtttcccagtgattacttctccccttctcttgctggagccacaaggagatcttccttgcacatttactatgagaacctggtggagtttctagacataaaacccatgaaattgtagagacctcagcaagactgtggctgtctgggggcttctcactctcattcattgctggttcacactcagcaaccagagattcactgaaattaccatttaagcattaccacaagttcatagctccagtggcttctgctttgagtgagcagattttggctgtgccctgaatttcatgtctctccatatttcagtgtggtacttaccctgcagcagcagtccctcctgagtccaataaatgtcattgatttttcatttcattcatttttttttttctgttgttatgagagtgattaattctaagctatttacatgccagagctaaaaaatgatggaggtttgaattagtctttgatttatacttatatttttgaggaactcatacttccttaatctgaggaaaagttggccaattctggaaatttctcagccattatttctttaacctttcttttatgaaactattttatacacacattgaatcttttcattgtgtccttcaagtctttcaagcattcgcattttccatctctttatctttctgagttacattttaggtcattttgttgagtctgtcttcagcttactaattatcatttctgttctttccaattcattgtttaacccacccattgagcttttatttcagttactaaatttttcattttgtaaagctcttacttttgttttcttccaaatctgcgtttttacccctagaatatcttattcttttactatgtttttgatttctgtagtgcatttaatcacgttaaacatatttattcagtattatccctctgatatttctcttgtctgtatttttgggggcttattcctcctgacttggttttctctctttcactcatggaaaatgttatactttatgtattttgtatttttgatcaggagggtataatcattgtgttttctatgcaacaattttttattattattttctttcttttgtcttttttgtggtttgctaatttgtttgttctcattgcgtctgtctgggtcctcaagttttactggtctagaacaacttctaagctaatgccatgacttgcaaagttcctaggctttgtgaattggttacatttgaattctccatcagaaagaaggctgatacattttcaggaaatagagtgtaccctgacctggttctccactttcagcccagaatgacacagactaacttgcttctttcttggccaatggtctcttcaaatttcctggaccatgctggtagaagtaggtggggggtttggttcagctctccacctacgaaagagaatcttttctatagtcccacttaggcattgtttaggctctctgtgaataacactggccactggtctccatactcctgcactctgctatggtgtcagctcacgtacttacaatgttcttttcaatttcctcttggattttgttgttgttgttgttttgaaggatttcttgtgctttcttgtgagccaaaatcagcatttaaaaagacatttgtttgattttctccagaatttccaggtgtttgtagcaggatagtattaacattatagagtctcctgttttctaggaccagaagcagggcccccatgtattatcctggcatacttaactagtttctctgtgttgtagtcaccatttcagctctagctatggcttctttgtttcacttccatttccaacttctgtaatggatgtaatctcttggtgtgtttgctctgcagacactgtgattatcttacaccgtggttatctcaggtcctgccttcatgccagtaacttaattttttagctgtgtctgttttgttcctttctgtttctcatctaactacgtaataatttgttttggttctcagtttatttgtttagctctgcaatgttccttttattctgttattttattagctcatctttgaaatcatgcttaatttgatccaagacttatatagtataatataaagaactcatgagaagcatgcccttcttatttgggcttttttccaggctactttgtatattagttgtgtgtgtatgcctggctgcctttcttctttgtgcttgttattttaaaatttttatttatgtatatatttaatcattcattcattcatactcatacttccttcttgtggctgtcattccaatttgttttcatctggcccatgcctcattcgtattttctgtgatgtagtagagatgcattatttttatgttatactttcctgattcgtggcctgatttatttttgtctttgtttcttaagccaattaacctatattatttatagaagtattagaaatatcaaataacaaaaacaaaaccaagaaaaataaatgactgcttctaaatcctgctcctaacttccattcattcatcttatccccttccctttctattggcctttggaacccactttgcaccggttccataccaagggctctgttggggtctccttatctctaactcagttccttagaggaccccaattgtgatgagatttgttgcagctagctttttgacaattcattgaaaaagcctgatattgaaattacagaaattttgtaaccaaggcatttgtgggagtctggctgtgtgtataggtgtttgcttttagtccagagagatacaacttgtaaacactcaaggaaattcctgaaaactgattcagttgggatgatggcttaaacttaaagggagatttatcctttctgttcaagggtagttcagatgaagtttgattcctgctccactcagtatgccggaaacccagcatctctcttcctctttctcctctactccacaatcttcctatcactacccattgtcagctctgctaattcaagatcgattccttctctgttagggtctgctctcatgatccaccttccaggcttcattccccaagaggtaggtcctttgagggagatagggggccctttctcatagaaggaaaggaaacctttcagttgcagtgaaaagtgcatgcttgaactcttcctccctccctgagaaggatggggcagctctgggcatgggagtccacccagcgagaaccaagtggacatcaggttgggtggggctcacctcccccgggcaagctctcttattcctgcacacacaggcagctgaacaccttggtctgccttgctcccttcaatctggcattgggcaaattggatctggatttcacaggggaaacaaaaatcagtggtgttgcccggatccaggtcctaagctcaggaaacccacctgcctctgttcacctggcatttattctccctaaaggagccaggctgatcagccagttttccatcttgtcatcatgggtctttcctgggattatgtctcaaggaatcacatgctgacctgttgggaggaaaaaaaatatgtatataaatatacatgtattacactgtggtctgattttttaaatcccttaagccttatacgttgcattgttcttgaaatcagtgttctcgaactgtgcaggattaactttggtagttaaaaatagaatcaaagagttcagaatcactctgctgggggagttctagaggcagaagtttttccaaagactgcagtctctgcctcagtggctctttggagcaacatctccaatctcaggatcttcggggtgctgtgttttaaagcataatgcatttcctctgtttgtcaggtttaacggtaccgtcagaaataagcatatatctgtaaacagttcggctgtgattaaggagctccagaatcctagaaatagtgaagttccttagcttaaccctttgccaaggtggctagctggtggatgaggccaggatccaaggcttgaaggaagtcaggttgcacacactttttgaaaagattctcatctgcacattgatgcatcgcagaataaccatgaacccactgggaatattaaatgctgacctctagacacttaattcctaagccttaattttcagtgggaaccaaaccaaccaggtttcaaagatgagccaataaaataacagaataaaaggaacattgcagagctaaatgaataaactgagaatcaaaacaaattattacacagttaaattagaaacagaaaaccaaccagtaattatgtgccacccctaaaaataggcagccgcagatagtgaggagatattgccagttcgggccaattctcttagccttttcagtacctttctatcaaaggaacttttttccgataatttaacagtggagaattttgctatattttaggcacttttctttttctttttcttttttttttttgagacagagtcttactctgtcgcccaggctggagtgcagtggcacgatctcagctcactgcaagctccgcctcccaggttcgtgccattctcctgcctcagcctcccaagtagctgggactgcaggtgcctgccaccgcgcctggctaattttttgtatttttattagagacggggtttcaccatggtcttgatctcctggcctcgtgatctgcctgcctcggcctcccaaagtgctggaattacaggcgtgagccaccgcacccagctcttaggcacttttcttcctgctacctattcagtccttgcagcatgctgcagagagagcaattgatagccattacccttgtttttacaaataagggaactgagtctcagaaaagttcaggggatgggactacccctagcccacatggctagtgaatagcagagcccagagcctgtgatatctatagttttcacattgtgtccccaacaaacagaccctgagcaatcccaaaatgtgagcagaggtagagccgagctctgtatcccgagagggccaggccctgtggtacgaggaccaggatggtcctagaaatgccaagctccccatcagcagctctcagacatccaggcttcaggactccgttgctctccttaacgttattgaagatcctctaagttttgtttatgtgattatatctatcaatatttaacacattggagataaaactaagaagcattttaaagttcagtaattcacttaatataataaggccattccataaatagcaagatgttaacataaatagcattttatggaaaataaccatatcttcacccaagaaatcagtgggaagggtggcgttgctttttattgttgcaaatctccttaatgcctcatgtaatagaagacatctggactctctgaccagcttctgcattcagtctgctgctggtccctatgtcctgtagcctccgcaaacctctatggaagactcaagggaaaagggggatgaaagagggaaataacgtctaaccattatgaaaaaaagatttgactcactggtcctctgaaagcatttcagaaacccaggggttccaagcccatactttgaaaacttctgtcttgtacaattaccaaagggaattattttccgtgatcgtaatcacagtgtttgctgttacaacaaggaggacagaatcacatcatggttcaaaacacaagtgttgaaaactaaactttatgaaactgaaatccaaccccctaacctcttaaacaggtttctgtacttagctgtgtgacctagggccaggagcttgtttgtttcataattgatatatttatgcattcctcttctcctttgattataaaggtaatacctgctcatagcaaagcattcaaacagaaaagagacatataaaattaaatttggggggtctcccataatctccattattaaatgagaaaaataatagtatttattttgctggattattgtcgtgaagccaaaatgcgttgtttgcgtgtgcatgtgacatttagaaatgcaaactctgtttaagggttagctttgttattttcaggtatcgtcaatacctgatacctgatatttattgatatcctcttggtaaagtacttgttcatcttttgcccatttttctattggattgcctgcccttttctgattgattttttggagtttatttcttattctggatatgagtcttttgtcagacctactatcttgctgactcagggaaaacctcagtttgttatgctgtaaaactaagaaaaaaatatggttggtgtaaagattaaattagataaaagaagtcaccgtttataaactttagactgctacacaaatatgaatttatattatccagctattttctctgcaaacaagaatttagaaatggtggtggttaggtctattgttatgtttttgcttttttttttttctcagcatctacacaaaggaaaaagaaataatgtgatgggagctctgtaaaatcacatggaatgatgttacccagtaattcacgaaagaataattgctgcagaaatgcaagatagcacattacgcattaccacgacagttgtactctaaaccagatagacgattattcagagagattgattttaaaaagcacgatcacttaaatcaaagcatgctctcaactgaagagctcagatggaaaaagaatgaagggagttaggcgcgttgactcgagggtgccttgccacaccggccttctgggattctgtggcgggctggggaccctgcctcctcctgtcttcatcccagagggagaggggagtgtagatcttgcaggagagccgtgtgtgtgagtagccacgtggtgacagccattggcactgagtgacatcgcacagattgcagcatgctcctcctcttcccacctgctgtagcagacagggcagctgtttgcatccctgtttcggaggagagaacattgaaatgcacagaagccaattgcctgctgagtcgggagcccccagggtcttttgcctgtgtggactctgctcctccatgccctcctgcccagttggggagggcaggaatagccaggggggcagcttgaggatctggaattgctgaaacccactttcacagtgcaatggtctgaatgtttttttcccccactaaatgcatatgttgagatctgaatccccaaggcgatggtattaggaggtgattagtccatgacggtgcagtcatgatggatggtccccatatatacaaggccccagagacctcccgcgccccttccaccatgcgaggacacagtgaaaggtggctgcctatgatccgggaagccagcccccaccagacaccagggttcaaccatagtggcaggttaatcatggacttccagccgccagaactgtgagaaacaaacttctattttttataagctacccagtgtatgatattttgttataagcgtccaaatggaattaaacatagagtctgtgctacttaattgcaggcccctaggttcctgtggaatactgttcttcgggagactaaatgtgcatatttattcacaggcctctgggccagggttggatgtttctgtcccctctcttgcaggaacccccttgtttgactcgggtggcctccaacttgggagggagtgactgctgtaggcagctctgcctgctgattcatggtttcaggctcaagtgctgcatggcaggctgggggctctggcagcagtgaaggatatttgggtgaaagagaaggaaacttccctcctggggtgaggaactggattttgtccctaggtaaattctgggcagtgggagtggagcccctgcatacctgccctgaatgtccttctgccgggggccagagggccatgtgggaactataattccatctggggactttccacactcagaggtgtggccaccatccccaggtctcccagttcacctgcagcctgtgtggccaagtacaaatcccgaggcaaggaagttgagtgcagagctgaagtcctcccccaggtcctctgtgcagaagcctgtcaggaagcagggggctgagctcagctttagtgcagcagggtcgggacgtgcttgccaaggatcgaggaaggaaaaggctgtggggaaaggggaggggacagatggactctgaacctgcttttggagcagcctctggggagggagggcttttcttgccagccggtcaaggtcttataggagaagacacggcacctgcagacctattgctgccagagtcccacagaacctctttgagaagggggaaaggggtcagtcaagagccattttgcaaatgaggagactgagtcctgcagcaactgcctctcatctgtggtcacaggcgtgggggcctggagacagtaatgcctggatagagccttggaaagcagagctggtggtgggaaccgagggataaaggctcaggactgggtgcacatggtggatgtgaggggatccacatactgtggtattgcaggatcacaggtggttaaagcagaggctcagccccaggacgccaccccttgtcactctgggtgaagtccatgtccttgtcttcctccttgtagggaccctgttttccctccctccgtgatccttgttaccatttgttgttatatgttgttataagtgtatcattattgtgttgtagaatcctacctcatccccccccaccaacacacacacacacacacacacacacacacacacacactttttattctaggagctcaggagcaatattaatttccactgcacacatcaggcaagcataatgctggggacaggaggtgttccataaatgttgcatgaacgaatgaatgaaaactcggctggaccatggcttgtagcaatggcttgtgcacttcactcaagattcttgacttgatcctttgggcagtgcagttggaggagggtgatctgatcatatggatggtcagaaagtccggtgtgaagatgagtagaggacagcctctgtgtgtgtgcacctgcgtgtgcataggggcagcaggctgcacagtgggaatgggaaggaggtgagggaccttgtcactgcaaacagagagccaagagactcagaccgtgtgtggcccggacaggtgccaagaggagggagattgttctgggagcatggttcctcatgccctcctctctccctcttgagtctttgtggggggttcccctaacgggtatccctgcatgctcaggtggtggtggctgctgcttgttgattacagtttgaaaagctgcacttggtcccaagttgccacacaccactgaaattcagtgttctctaatggggtttctgttagaatgttggaaggaagaaagccttttaattagattcgtagtaattgagctcccaaaccacagaagcctttctctcagcagatgaagacacaaatgcaattaaaagaaggaaaggcacctaaatggaacccttgctaattttaagtccattaaaaacaacaactccttaataagttgaggcaacagatacacgttctgaagagttttaacagtgcttcccaataatattggagcttgaactggaactggagtgctccagccacttaaatggatagctctgttggggatcatttgctcagtgcagagtacagagacatgttagctctacagcttttcccaccaaaaactcctggcacattttattaggaaaatgggatatattttttcctgtaactgaataaatgttcagcatcttgtggacattgcctctggcctggggtcccctgagacatcatcccatgtccctccccaggcagccctctcctctctgtgggatttgccccacctggcccatctcaccccagaggtgcccaacatgtgagcaactgggctggggcactgatgtccctgtcaactgcttacatgctgaacgcattttcattttaatgagaggcagcattcgtttttcatttgcatccctgctcactgacatgccccagcagatgccacgttctttctgcctttgggtctttttttttttgaaacttcccatcggtgaaccaggccaagtagattctattgcgggagcttgaggtttcagcttctgggaacatcttcacaggggcattaattaatattttccctggagagggtgtcaattgctaattcacagagtcctttacgttggagttgattatttcatgctgaatcacaacattctcagtatgactattgtacagaattcactcatttgcctcctttcactgggcttggtcagccgtactaaaacgcaagttgcctcccatttggaaaggccagtcttgacgggtctcttctctgtacgtcctgtgctggagcaaagtcacagctggtacactagccaagctccctgattagtgcataggcttagctggaggcagaactcagggaggtgttttggaaatgtaggaaaataagctctggagtcagaaagatccaagtttgaatggctgcttctaaagtcacctcatctttctcacctttagtttatcacctgggtaggctttaccttcaggtgtatttcaagagcccgatgtgcctcctagaagttagaggttgagagaaaagcccagatctgcagggacaaggcagagtcatggccctcatggcaccactcacacagggtgcagcagctccacacagggccatggcccctttcctgggggagggaggcataacatacttgtatttgtttaaaagcatatatattttggaaacaaacctgactttaaaaacttgtattttcacctacttttatgtttttttttaagcatatgaattatttaaaaatacaaagataaatagctaaatcattagcaggcatcatttctggatggtaaggttgcagagttttaattttcttctttatacttttccatcttttttaagtgctgtataataaatgtgtcttactttggaataaatagaaaagcttaactctagggaaatgctgcttgcatatattggaagtgcttggtgcattctaatttccacacacaacaacgctctcgacagtcagatccccatgtgaataattgtctcattctttcttttgtaaaccatattatttatgctgctgctttttttttttttttgaaggatgagaagaaccaagttttaaccaccaacatttggctgcaaatggtaagttaagagaatgacaatctctcccatgggctgcaagatcttgcacccaagattcttgttctgatacctgagatgcttgcttctgagaggtcctgtttaggaaaaaaaaccaaaaaaacaaaaggccatggctgtcacaccaactccacacctgccaacaatgaatgctggctgtatgacactacagtctgcagtgctcaacacatgcacaagatcaacacataggacaaggtaatgtggggacacttcagaagcacttcaggcaagacaagaagatacagggctgtgtgtagatgtccacaacctgcaccacagccagtccccaggactcagaagctccatccctgccctctgtggcctccggagctgcatgtttgaatcaggtggagtgttccgaaaccagaggccctcgtactttgtgctctagcaatgcttataagaatcttgaaatgctacctatcatttgtagatttttaacttgacatctgcaatactaatctaaatttgattaattgcaaatgatgccacttaacatccaattgtaaatattaacactgaaaaatgaaacagtcagtctctattttaaatggaattcaaaataccataataatttggtgcccatctcattcaaacaccatatgaacaagcctttttttaaactgtcagatatttaacgtagtcccttttttctctttgcacatgcatttctattctagtttctatacggaattttatcctaatgtaatataattttatgtttgaaagtctcttttttgtttgtttgtttgtttgttcgtttgtttgtttgagacagagccttgttctgtcatccaggctggagtgcagtgcagtggcgcaatcttggcttactgcaacctccgccttccaggttcaagtgattctcctgcctcagactcccgaacagctggaattacaggcaggcaccaccacacccggctagtttttgtattttttagtagagacagggtttcttcatgttggccaggctggtcttgaactcctgacttcaggtgatccacccacctcggcctcccaaagtgctgggattacaggcatgagccaccgtgcagggccgaaagtcttttattaatcgtgccttggttttttcaaatgtaaatatttacacaagaattattcctttacaccgtaagtattaaattttgtttcttttggattgatttaagtttgctattgttattggtattataattcatcaaggtgacataaattaaaatttttaagtaattataaaacataaatttttattggcaatttatatctctgcccaagatgagtttgttttaaattagttcatgtatccacagatgactttttattacttgaatggagagaatgatagttttcacttcaattctgttgctgttttttaactaggtgtagtaacatgagtagttggacatgaaagccactttgttaaagcaatgttactcaatctttgaacttcttctaggttatatgccaaaaataatgtagtttttatcaaatgtatcagctgacagcttgattagtttctccttcaattttgttgaaaacaaagaaaagaatttaaacccacctgacctttgaaagtatttgccacccaatttgtaaggtaattcacacagacacaaacgctgatacttgaattgaccatttgtttggttcttgagtcagtgtcccaagatgggagttgaggtaagataagagaaatgtgcccttctttataaagttgaatgggagaagtgaaaatggaggcaaaggatagtcccatgtggttcttgggcagttgagttatcctgcgaatacacgtggagttgagggatagaaaatggatctgcatccagcctggccaacatggtgcaaccctgtctctactaaaaatacaaaacttagctgggtgtggtggtgcacacctgtaatcccagctactcaggaggctgagccaggagaatcacttgaacctgggaggcagaggttgcagtgagctgagattgcaccactgcactacagcctggggaacagagcaagactcaatctcaagaaaaaaaaaaaaaagaaagaaaaagaaaatggatgtgcttaaagccattgctaggtctccaaggtgcacccatagctacatgtgagactcctgcagaacctaacattagtcaggtgagagcccttgagatattcccttgcaggatttaaagcagcatacttcagtgagcatatcccttgccacctactctagcttccctccttttgcccaggacacatgatctgtgctctcctggaaggcccaggccttcttcccatggacagactcatctcctggcccctgctgagagcctggcattaatgattgtcctcgctgccagtagcatcaaaatagtgtccgtgggtcattctcactcttgtctctcccacagacttttcatttggataaatgttaaagccatggatccattggctcaaaccaaaaaccttgaagtcacccttaactcttgtctcgcacaccacctctgatacatcaacaaatcctggcagcttgacctgcaaaaccgatccaggatctaactactgggcatcaaccatgatgctttcaccctggtctacatgggtgtcatctctcacctccattattaggagtccccatccagccttcctgcttcagtgttgcctcttctggtggtgtcttgtcctcaacatagcagccagcatataccttcttggcacagatccctccaggggctcctgtctccctggacagcataggaactgaagtcctcgaagtggccttggattcaattccctccttgcctggctcctttttcctctcccctcccctctgttctttgtttcctggctgcactcactgtccacttgttgggtgacacacacgtcacccgagcccgtgccccccgctcagggcctttgcactggctgctctccctgccaggaagactcgtccctaagaaccacttgatttcccccttacttctcactgatctcttcctaaaggtcaactcttcattgagtcttctttgagctccgatgtactgtcccaaaccctcccctccacctccagcccactctgttctctttatcctgtttcatttttctcccaaaggcttctcaccatgtaacccgctttgtgttcactcgtctatctgttcattggttctgagtcttcatcacccttagaatgtgtgcacagtgtgggggacagggctccaggtgcattcggtcactgccgtacccacagcccctagttcactgtctcacctgtagcgagcaccaaagaacttttgccgaatgagagaatgaagcaaaaactcaaggtgaaccttgaggtgcttgggtagcgtgacacaacataaagccatctcctgaatggccgtgcagcactttcgtactgtgtgtataaggccaggctccggagaatgaggcaagtgcttccctttttaattaaagttggacgtttgccatgccctctaaggaacaacgctgctgttgacatttttcttacagagagaaatgcatgttatggagaggtctctctccctggtgcctatcttccttagccctcagtaagtgactggtcttcagcaatgtatatgatttggcaattttatttaaaggatggtggtttccaagaaaaatgtaactggattattacttccagtatggaattcagatgctccacaaataaacatccttgcttcagagggtgtcaccagagacctctaaatttatttcaagcacagctaattttaattaaggcttacatttgcagaagcatctgcagcttcatttgtttgaaaactcaccttttaactcacctcctcttggagcaacctactctgtggaaggtattaaactgggccaggtgaggggacccagaaatacataacccagtttctacctttaagccatttatgatcaggctgtgtaattaacacgtttagaagaaggaggcggaggagaagaagaaggaaaagaggaggagaaggaggaggaggaaaaaaggaggaaaaatgaaggaggagttggaggaggtggaggaggaaaaggaaaagaggcggaggagaaggaggaagaggaggaggaagaggaggagaggaggaaaggaggaggagaggaggaaaggaggaggaggaggaggaaaagaggaggaggaggaaattaaaatagcaagaacaagtatctccccagggatattacagatgacagctggtggtcagatagtagaggccagacgtgggagaaatctctgctttaaagaaatgggagagaaggagaggcacaaattctcctaaacgtgaagatctgggagcactggcatttctgagtattttgtcattaatgtttacttttaggtgcctaccgattgagaaacatgctggattcccttagaaggtgtgccctcataaagctgggtgataacatttatctggaaagcggcacctgtagatgatctagcagttgtaacactgtctcccaactgaatttttaagggctcacaagaatcctgggtttaaaacaaaccttaacagtcatctagccagtgcctgtgtctctctgctccccgcccccacccagtgtttcagtctggaagccctggcatttctattcatgtccacagcatggacatgaggaactcaggagtcaccagagcaagcttggatgctgcccagaggccacttctaagcaaccttccattgattgctgttcttgtgttccctggctggggaccagcctggcttgacccagcacgataatggacatgcacaagtgaagctgggtactgaaggctctcagggccagggttctgaggggggtgcaaatgtgggccgggggcagagagccataaaaacggctctagcaatgggtttttctcctcccgagtttcatgttgctgaattcctgtccagaaaatctgaatccacataatcttttctctagggtatttaaactctgcaaatgatacattttctgtttattaaaaatggaaaaggcagaaaggtaaaaaaaagaaaaaaactctccttgacctccagtttgttggttttgttattctttctcccagttgcccttgattttgatcattcagaaacgtgagggaggagaaagaggcttcatctctctgttcacctcttcatgttccgaggaggaagcagctggttcctctgcagccggttcctctgcagccagttttctctgcagattagtttttatcattttgagagggttgtcagacataatctgatttaatctatgagaaaaaaatgacagaagccatttcagtttctgaagagacatttgaaccatccagagacttacatttgcttttaaaacacctgtcttctgtcattttgcaattgtgaccattctcctggcatttgatgtcccagccttcctgggtccttctctaactttaacctcctaattctaattatggtactaatagcattcacaccatagatgataagattttaagctgttattttttctaaaatatttacctttttaatttctgcattcatcatcacttgatctctgacacatggaaatgccacgcttcctgtttacagacaagccggctagtggcttgcttagggctgtgatggcatctcaaggtgaagagcgatgtgtcaatcattatgtctcaccaagagaagaaagcgtcagggtcagtggggtggaaaggctgctttcctccactaacaaaataatggacgggaataattttgaaaagataagtgttttctgacatcaaacgtgtgatgacttttctagcaccaacaaccaattttccaccagcaactgggggtccaccaattcaattcatttctcacattatctacctggagttgcatcagatcccacaggttaaagggctcagtctcacttcagataccagctgcaaatggtgtacccaggctacccacatgtctagcaggtgactgaaaattcgagggttcccatacccttctcccccaggttcaataactttctaagatgactgacagagctcaggaaaatactttgcttacttaataaaattttaaataatatacaaacttatttaatatatttataaataaaatatatttattaaataaatatttaatatctacttatataaaataccctggagaaaagattacatggattcagagtttcagaacaggaattcagcaacatgaaactcgggaagagaaaaacccatgacttaggtttattggcttattctaaaggatgcagctcaggaaccaagtggaaggacgcagcggacagggcgtcgtggccgcaagggtgcgcggagctgttgtcgtaacttctcgccagtggccaccttccctgcaagtggatgtgctgaccaagagtgtttataaccccgtctcgagcccctttctcacccctccccagagctgtgagtgcaatgggcagaaagctctttactccagtcactaggtgaccagcccccatgaaagctatctaggtgcccaaccctaagtcacctcatcagcgtaaactcaggcctcaggcatggtcagaaggggctctgtatgaatcacaaaagacactcctctcactcaggaaattcccagggctttggaagctctgtgccaggaaaaccaaatctattttcttattataccataatgtatttttttaatgaaagataactttcctttttcctccctcccttcccctctctcatccctttcccctcctccgccctccctcaatgcttccatgccactagcatccacacacatttagagtttcctgtgggctcgaagcagcacaaatagggcccaggtgccagagccatggaagaattgggattcccccagtgccttttagatcaatggccccttcctcccttcccttcagtgtcccctcacaactccacacactcttcttttgaagatttaatgagaaggaatctcacaaaaggagggagagaaggaagagcacacactcctctaaatgtgattgtctgggagtctaggttcattgacgcttcttttcagatccccactctgtggaaaacgtgtcaggtgctgtctacaaagattttgtctgatgccccctgttcccgagggacctaggaaccaagtgctttcagagaacaaccttttttctagaagtttgttgtttgtagggccttattccatatccattcttgggaaaccgtcatgggagcctgtgggggttgctggtggggcccccgggctcaggattgtggacctgggctccagggcacacagcatgaggttcccactgcatgttggcactcagtcttccccacccttggctgcagctatgttatgactgttactacagctcccaagtccagcaggattttgtaaaatggggaaatctctctctctttttttaagccaccattcatcacttgcctgccagggccatatgactttaatctgctgctgcacacattatctcatctcatcctgtgaggcagggtacatgtaaggaaactgcagttcagagacaatgatttacctgaacaagctcacgccgctagtctctgccagacccttggtgcaaacccaggtctgtctgatgcggatgcttttggcagctccccctaccttttctgccactacggttacctgaaaagggttccgatccagaccccaagagagggttcttggatctagtgtgagaaagaattcagggcgtgaaagtaagtttattaggaaagtagaggaataaaagaatggctactccatagagagagcagccccgaaggctgctggttgcccatttttatggttatttcttgataggctgaacaaggggtggattattcatgcctctcttttttagaccatgtaaggtaacttcctgatgttgccttggcatttctaaactgtcatggagctggtgggagtgtagccatgaggatgaccagaggtcactctcgtggccatcttggttttggtgggattcagccggcttctttactgcaacctgttttatcagcaaggtctttatggcctgtatcttgtgccaacttcctgtctcatcctgtgacttagaatgcctaaccatctgggaatgcagcccagtaggaggtttcagccctgctttacccagctcctatttaagatggagtttccctggtttaaatgcctctgacacaatggtcagcctggtttggggcaagggaaaacagcagatgggcagcagcatcagggagattgagccagaagaaccagctctggtagaacccaaagatcagtttgcttaaagtcaaataacacaggtaagccctgacccagtgactgactaaaacatcctagctttctgaaccctggcgtcctcttgtaaatggaagcagtcatatcactgacccccccgaactatggtgagtctgctatggtgagtctggacatacacaggacactggactagcataaaggctgtgatctggccggggaggggatgagcccgtggtttacgcagtggggtgtgcggggtgtggggaggcagcgtacagctctggctgtgccttggacgaggtctgggtttgaccatccaagcactcccattcccattcccagttcctgtctcccctccctctctggccatcattcagcaggcagaggagaaggagagaagtgccttggcctaccatgcccactttccagggcagttcgtggaatcttggggccctgacctgtgtggtaataatggtgaacgtgactggctctgtgataattagtgaccgacacagagaagcatcccagggtgagatgcaagactgtggcacagaaagcacaggtgttggctgtggcagggccttgtgcccagggcaagggagagaaatgaagggaagcacagggcagaggtgccaagttggagcaagctgcaggaagcatggcttggttggtgcccaggcattcctggaagacaactaggacaagacccaccattcctgggtgtgcccctcctgtcccctccccaaccacttccatctcattagagaccccagcaggcagctgtcgatcctgaatgccccagaggatacttctgcacatcacccattaacacatcctcattcctggaggtccctggctgcaaaatgatgtcactcacctggatagttcctctcctttgatgtcagattagatccttccagacttgggaccatctttctggatgctgcctgccctcctcagagaatggttggtctgggacatgccctttgcttcccttgttgtatcaatagctctaggcccacagcccctcatctgcaattcccaaatctcagcagctctgaaaatttttccccctcctttgatgttgttttcgtaactttgcgtcaaattattttggtctaaaatcaaattgaaatctatgtgaattgaggcatttatttgtctcacttagtgcaaataggcatgttttgctgcagaaattaccatgtatttgattgtgaggagccaccctggtcccaggttggggtggtgcatcacatacctttctggatcttggaaagcctgagcttcagagcatgggtggtaccagggggacagaatacaggataatggtgcaattataggagcttctgggctcatacttgtcagccctgagcctcctgtggggtggtgctggttatgtggcagctgcaggtgggatcccacccgagcatcctctgcagagcttgtgggctccaggaagggctgtttagcacctgatcctcggagggatgaccccagacgtgggtattcctctggcaaaagtcactcgataacctcaattaaggcctggccgtgagcttgtgtgagtgcttcctgagtcttcacctgcctcctttcgtcctgactctgcgtttcaccatcagggctcaggatttgcattgtcgggtgtcggaagcactatccctgtgacaaaataaaaattcaaatctgaaaacattcctttagaaattctgagaggttcccatgcagctgcacagtattgctttatggaaataaatattccacatttctccagcctggttcttagtccagtggaaataagtgaattccttttttcgaagtattcttacagtgaaaacttctaaggcaaaacagttattcatttggctagaagtaacccatctactgcaggaggagaaggctcggggacatgcagagggttggaattaactttaatgataccatctgaatgtgttcatggtgacagcagaaccttaaatgtgagttttatgctcttcacagtcattttggaaaggatttttgaattcccattttcattatattttataaatagcaattcagttataataaatgtctggaattctctttggttttgcacttacctaataatcgcttatgagaaatattagtagccaaggaagtgaagtgctgctaatgtcattgtgtgtgtcagtcttggacagatcactatttacagtggaatgtgtcagaatatccaggggtgaagactgttcgtttcccagatggccagatttggaaaccagacattcttctctataacaggtaagcatattgaacaaaggaaaaaaatgattttatgcttgcatacatgtagctatcacgtatatttgaatatttcacagagatgctggatatgttatctatgatctggggccactgctccctacacggctttccgagcggccaggcctttgagaagcagctctgtccctgtaagccagcattccctggtttggcatgcacacgtgcacacgctggctagcctgctacttaagacgcccatgaagttgtatgttctcggggcctagtgttgtttctgtgcatattggcacatggagtattcttgcataaggcagtacctttgttctctgaatggcagcagttatgaccaacagcaggaagtgctggcctatgggatgcactgctggagcccacagtttggacccacatcctcgtctatgttccctgttgtgcattggagagttctgtggcagagatggctgcaggtgagcgtgaggactgtcatctctagctgcatgcagaaacttcccctgcagggtatatacctgatttctaatagtctttctcctgaggtcaggaaataagggacacgtcggtaaaccaagacagtctgacttgcagaccagatgcctaaaaggcaattattcaggcagggtaagtttctagaagcagtaaaatttctcgttaaactgcatagtcaaataagggatcccagaacatttctgactaataaggtgtcagacctcataaataacatcatgaaaagaaagttatttcctaatcatgaccgctacctttggtcatgaagaaggaagcccaggctttcctgatgcagggaacagtgtgaccaaattgccctccatggtcactcggtgatcccgctggacaagcaatgtgttgtcctacatggctacttccagaaggctgggcgatgctatttcttgtatggacttttcattctgcctctgtctttgcatctgggggccggccacatttcacttgaatcattgggcccgtttctagaagagtatcctcttctcatttgctgccacttttctgcttctcaaattagttcagacaactgagctttgaaaaacgtctaaaataggagtaagtggtcccctgttgaatggatcaaacatgtgcctttccatgcctggactttgggtcttctgtttcttggggggctgtattagtttgccaaggctgctgtaacaaagtgctacagactcagagccttaaacaatagaagttaccctgtcacaattgtggaggccagaagtctgaatgaaggtgttgtcaggactggcttcttctgagcctctctccttggctggtagatggctgccatctcactgggttcacgtgaccttcgcttgtctctgtccgtgccctagtctcctcttcctgtaagcactgcagtcaaattagagtagggccccatgctcatgaccctcttttactttaattacctttttaaaggttctgtcttcaaatagagccacactctgaggcaccaggtattaggatttcaacatgtgagtttgagggagatgcaactcagtccataatgagggcattgtatctgactttttgagggcaaagggtcagggttgaagaagtctccgtgttaattttagctgtaatatttacagtctgtataacctttgagtctcagatttctcctttgaaaaacggggaaagtgccggcttcacagagttcggaggatcgctctgtggatgtgtgtagcacacttagtctggcacttggaaaagagcacacattccgtaaaggcagttgtgtgtttacaggcagaatgatgaggattcctgcttttagaacaagatggtaatttaacaatttagaaaaaaataatcaatgtttttcattttccaattcggattttttaagtttgaaatcaagaataaattttataacattcagcctgagcaatgtacgagacccccatctctaacaacaataacgacaacaacaacaaaattagctgggcatggtgacctgcacctgtagtgccagctactcaggaggctgaggtagaaggatcccttgagcccagcagtgagctttgattatatcactgcttgccatcctgggtgacagagtgagatgctatctccaaatatatatatatatatatatatatgtatatatatatatatacatatatatatatatacacatacatacatacacacacacatatacacacacacatacatacatatacatacacacacacacacagagagagagagagagagcaccccaccatattatatgtataacatgttggtggaatcttattaacacggttacaagaggcagtttatatggcctatgtgtaggatctttaactccaaaatgtaaaatgtttgatgattccaaatgctctggctaatgaggaatttccaagttgtaattgaatttcaaggagcaaagatagagcagtctctacctgacaaatgttaccagggtccaggcccttagaaatgatccccacctccacatgcctgacccagctgccggtgcagaaccccatcgctcacacatctgttgagctctactgaaggatcctgctcgttcctctttcccatggtggacatagaccacgtccgccaggcttcatcatggaggatgtagaggctgcttcaatttctgcttttgttttcctgagacatggaatgtaggactttctttttgaagtaactactaaatatattttgaagtaactgctaaatatatggcccgcaggtccacatgaacccaacgtggaatgaatagatttcagagaatatttaaaccactcatagacacttatctattgctacagaacaaactcctcagaactgagtgacttaaagcaaacaactcagattattcctcatgatgccgtgggctgtccaggcccatgtggctggttgtctctttcacgtggcattgggcacagccatgggctggggctccactgggccgatgtgctgaggggtacacttccacagcggggcaggtctgggctgagctggtggggacgccggccctggcaggaagctcagccattcagctggggactgtgcacccaccccttctgggccttttccacaaggctcggtgtcccccagcttggtggccagcagtgctctgacaggaaggaaggagaggctgctgggactcttaaggactgagcgtgagggtcccgcaacagcccttctccacattctgttggtcagagtaggcaggagcccagcttggagtcaagaaaggggaaatcagcacccctatctagggcaagagggaggccacagggtgctctggggacactagtgatcacagctaaggaaggaaagcggtggaactgcaagggtcaaagtaaagccccaggaaaccgaaagaccagaagaggcgtgcattgtgaaggggaaggcacgctccgccatgtgcctgctgaaattggcaatgtgggaggagaagcaggcaggaggagagagcttctaaacaagacagatcttgtcatctctgcccccccttgctggctggcttccccttcctgcctggacacactgtgcagcccccaggtatgtgctgaccagcctatccctaccctgtagcctcgtccactctccagccctactgcttgtcctttggctcattgatgcaccaatgcttccaggcagagtgtttatatgagcgtcttgcggggcgaggaatgcccaccccttaactcccagttagcaagggaaacctccctgacaccctcacccctgccaagtctagaacacatttctctgtcacgtagaaaaggattcctgtccacgatggcacttagggtctgctacctcttaggggcacctagcagggcacttgatacacatttatgcaaagacaagatggagagaggaagggagggtgcaggaattattaggaggaggagcgaagaagatggatcagtgtaatacagtgcggctaagaacagccagagaagaaagaaagcaaaggaaagaaatcatgtaggcaacctagaaaacattcaactgagactgagtccaaaaattcacacaggaaatagcaaaaatagtcttcactactaatatcctaaccctctgatattctgttattggggattttgagagataccgaatttaatgctttctgccagcttctaggcgtggaaaataatatgttctgcttagtagactcatctgttagttcattatggtctgaatggagtcgaggggcttttcctaaaggagggggttaaatgcatcctgtgtaagccccagttttgaaagcagtgttgatgtagctcagctgaagcctcccaaacatgtctgtcctatttctcactctattctcgtttgatattggagtccccacgtgagtcactattgctttttgagatataatgcattttccatgctttaaagtggctgggtcactgcaaaacagccatctctgcatcatttgtggaatgggctgctgtatttccttgatgggtgggtaacaagtcatgctgctgccagccagctggccaggtcgctctgaggagaggatgggcacgaataaaagcgtctctgtctggtgctgatcccagtcatttctttgttgctttattttgctttactttaagcctgcggctcaaggagttttctgaacaccatcttgcctaaagtgggtagcaattatggatggcttgccgtgattttcccctttggatggaattaaaggccttgctgggatcagcagtccgcttgcagaaggacagtctgaatcccgcaactctgcggatgcccctacaccgtgcagagacaggcaactgcctcaccctctctgggcttctctgtttctgagttgctcggtcagaaaattctattgcaataatggaaatcttttttgatgaagatatttaaagatgtttttgttggctctgaaagtttagaacagcatggggtttcagccatccattttcattgagtgtgcaaagctgcatttgtcatctgcagggttgtgtctttcactcattttcctgaccctgtggctgatagcagaggctggagaggggacctctatgcaggacacacttgagagcagtgtggccaagcctgtaagcactcataattgtgctcatcattgttgccaagcgtcttagggaacctgggggagccaacccaggacaaggattcctgagcatgtagcttatttgggaagggatcctgggaagcaggatgaggggagggggagtgagatagggagggcaggcaagccgttggagtgagcattgaaaagcaaatcatactgcgggcaaacagagcccattcctactggggagctctgggagactgtgtatagcacatctcagccttgttctgaggaaactgggatgcttatctgccagctgccttccatcataggctgagagctgcttccaggggtgtcagctccctggcacctctggcttgcctgccccatgtgtggatcaagtgcagagctgcagatgcttgcagtaggcagctgtcagggccttgggcacaggaggatgattgtcgacatggtctgctacagcgcagatgagccatccactcaagttctagttgctttcaccctgctttgattgtagatccaatctcagcttctggtagggagcatagcaacaatatgggtggaagggagagagtcctaggacttgagggtcctaggggtgagggtgttctcagccagagcagaggaggcaggcaggtggcaaatttcactggactaaagaagagcccaagcctgcatcccagcaaggggtgcctattctacgtgggctgcgatgtatctattatggagtcatggcagtgcacacatggaatggcatcttagggagtgaatctgtgagatgtagtgttgtcatggttaatagctcctgaaattgtggtatccctcagcctaaccgagattggcctgctggtgctcaaaggctcataatgcagtcatggccaggctcttggagggcccaagggcatcactggaaggtgatgtggttgctatagtttgaatatttgtcctttacaaatatttgaatatctgtcttctccagaatttgtgttaaaatttaacccctaatatgacagtattgagaggtgggacctttgaaggccaactgggtcatgagggctctgccctcatgaatgctttaatctattcatggattaatggatcaataggatatcatgggaatgggactgataacttgataagaagaggaagagaggcctgagccagcaccttcaggcccctccccatgcgatgcctggtaccaccttggcactacagagagtccccaccagcaagaagccctcaccagatgcagctccttgacctcggactcccagcatccatactgtaagaaatgaattcttttctttataaattacccagtttcaggcatcctgttataagcaacagaaaacaaactaagacagtagtagttccaggtgagcagaggtaattttgctgctggagatctcagagaaggagttttgaggatgtgctgttacagcttctgtattaatcagatattcacacctgagctggagggaggctgtttctaaatcatgtgttgtgggaagagggggagcagcagcttgttttaaagcagtgagtggagccagccaacctatgtttgcatcttcaaagtcatcctccgaactgtccatctcactctcccaggtctcatcatggtcgctcttgctgtttgtttttaatttgttcattcactcaaccaatatttagtgaaggctccctcagcataatcacacactgttctgggaactaaggattcagcagtgatccagccagacccaaacccaccagagaaacagagatggggaagagaggagggaggcatgggccagattgtaggtgatcccagaaaaatgaagcaggaaagggaatagtgagggctgagccagaggtcagggagagaccaggagacagactagagggctgcaaaggaacaggccctgtgatatcaagtggagagagtgttcctgacagaaggaacagccagtgcaggggccctgtcaagaaggcttgtgaaagacttcgaaatgcaaaaaaaaaaaaaaaatagtgagggaagagaaaaaaagacacctcggttcctacagaatactaggcatggtcacaggcaccttcctggtcatctgagtctgtagtggactgtgcctgtcatggtcttcaaactagttttcaactctaacttctagaaaactgatggcaaaaccaatgattctagtccacggagaagcaaatgtgttttgctggtggaccaattcccctgttgacagattcagatcagtgtgcctggttgtctttgtatgtgtctgcttttaggatgctctgcagaattggttttaacattttcctggttccttccttcattaatgacttaagtagtctttgacacacgatcactttatatttgtgcaagtgtcatgattttatcttttaaaaaatccatcaattgccctgaggcgggaacatgctatccaggtctgtcctaggagcaaattcagctgctgtggctggagagaattggtggatggggaagccagggttcagagagagggtcagagacatgatgggaggagctggggaccaagtcgtggaggccttggctttgactgtgagacaggagaggccctgatacctttgacagaatttttgtttcagttcctttttgctttgaacattttaaaaaaaaatatttattcatattctcctcttgacttgttagcaattgattcccatcaggtgattttgtccagaagttattatctgttcttttctgcttgtacactcctcccagcctgtggcagtgggcaggttttgcttttgttgtttcttctgacatctcagcaagaggaagggaggaagggcaagtgcgtgtgtgtccttaatcagcctctgatggcccagctgtttgcctcgggctaactcggagcccacctgtctgcaccagagtgagtggactgtcgctggctgactgttaatgctgtctgcctcatccggtgcttactgaaggtcccatgcactgcgttcagcctacttgcccgcagctcctggtcttcagcaccctggagccaagccccctttactgggcactcgcccagtgccagcagatgatagccaggaaattgtggctttatgccttctttctggactttatgaagtctgtttgagtgtccacaaatctcagggcgggaagctggtgctcagagaggttcagccacttgcccgaggtcactcagctgggtctgcctgactccatagtctgactcattactggccagtctctcgacacatcaggaaagagctcggtctcttgtgctttattttctaaagttaaaaagcagagagatcccctttccctccctctgagctggctccactttcgcacctgctctgggctgctctgccaggctcagccttccacttcctaaaaagagtgagtttgttttctctgaagctgctgtggggttttcttttcttttcttttcttttctttttctgaagctgctgtggggtttactgtcgcctcttgactgatttcactcagcatctgacattttcttttctttgaccaaatcccctgccagccagtgtgggccacagggcagtgccacagcagagcgtggaatgacagaacccaactgctgtctgtgcaagagtttgagcagaatttcaagcagaggacaggtgctgcggtgaatagaattttgtggggatggtgttgcattgaggtggcctgggtgaggctgtcttctggcatgtggcaacgggccagtccacggagcagctccccaaccccctgcacccccaagggccctgaagctaatcgtgcccaagagcacggcttttggagatgagcttattgatctttgtgatgtggaacacagagccagcacggttgtaagggctgtgtgataaatacatgagacaggaactcaatgggcggttcagtcttcatcatgagctgcctgagggagcagtgcgggcagccaggtgagggccagggtccgccgccaccccgccccttcccgagcctgctgtggggtccctgcgcgtgtccactgcccactagagatgcgctcttcagctgtctgcacaggaggagacttaggaagttgtgtgtgaggcatcagaaggcagctgggcctccccagcatgctaagacctcagcagtgcagggtgtggggcccgagctggatgtgccccattgcttgtatcaaaacctggagaaacagagctttccttgtgggccagggccacatggtcggtggagctgatgctgtcagtcggccgggtggtattttctggggacctactctgtgtaagacactgtgcttctaggaagacgcacattcactgccctcgaggcatgtgtaatcagtagcaaatcagtttaccgtgggtggtctcatctgacgtatttttgtgtccttcagtgaagtcatctaaaattactctgcttcacaattgaggaaatggttcctgaaattaaatggcttgttgacgcagttctgaggccttgactccacatcctcgtgcctttcccagtccttgacaggctctttgtggctgtaagacaagggcacaaagtgcatcttgcagagcagaagatgacgtatgtcagggacataacatcttagaaagatctggaagagagagagcctcatccagtgggagggtgtgggcaactgttcacggcagggtggccatacgtcttggtctgtctgggacagcccgggtttgtgcctgaggtcctggcactgctgttaatggtgccttttttcacttttaagatggggcatttcatggaaagatatgtaagttaggtcatatggcacagggcccttagcggggagggggagagatcaccttggaagggactaaatgtggcaggatcctcaatgcatatgcttggaatgaaagggagagggaaaagaacagaataatcaggtcagggactagctataatctaaggaattgccaccagtccaactggacttctctggaaatctgtccctgacgcctggccacagtcgcctactctgggctgctgtgtaccttggaggactctttgtaaacatcacacgatgctgcggatgtgagtttgatactcttgtttttccccactgtccagtgagctccttgggagcaaccaagttctattcacattttgtaatccccccaagttagtgtgacaagtagcacatggcaagcagcacatcgcagtgggtgagggactagtggggccactaccctgttccaggagggagttgctggaggccagaacctgggcagaaccttggaactcaggctgtctggatcaagagagccatcttctagcacccttagattaaaaataagtaagttctgattgtgtggggcagggatgtagggtatgggtcctatcccgagaagcaaattagtctagaaatgattctcctttctcctccactacccataccaatctatcttgaaggattatgcatttgaaattactctagtcatcttttcacattatttgtggtctttttttaatataaattttacatccttagctaatcacatttttgtgttgtttcctttatggatcctttatggctttggggtcccagaccaggagactatccatttattctactaaatagtttgttttttattgtgtatggttttttttccctaaaatgtttgtgtatgctatgaggtaagggtctaactttacttttctttaagggatagaaaataattctaacagcacttattgagcaatacatctttctccccatggcattgaagtgggatggttatattcatttatgcatgtgccaataccatactgagagctaagcagggtgaataaaaagagacatatgtcttgaatatcttgctgcgattttaaaacactcatgataaaggcaaaacccttataagctctcaaagcaaaaaaaaaaaaaaaatcacaatagcaagaaacagtagcctagtagaggactactttcaaatattgaagggcaattatttttaaaataaaatattttgttgaactgaactttctgggcaaaaatgaaagcagttttaaatatgtaaagactcaagtctgaaagaattactcagaattgtattccagcaaaatgagaagaaaccaagaaagaggcaaacctggaatataatcagcactcgtgagtgatggaatcactaaaaggcatagttcagtctaattatttgatgatgttgttaaatggtttttgttggcaggggactaagaagtagaagaagtaacagcagacgtttggtgtcggccttctttggttcatgcatgataaagataaacctcgttaaatgcacaaaatgaaaaaaagtacaagtaaatatgtatgttaaatatttgaatagctatcagagtaacagaaatagtgtcataacttccagaccactagagataaaataagggaccaaaacctgaagtcgatacctctaatgcaagaacagaaaactgagaaacagtgtaagtatgaggtctctcatggatccctggcatgggtatgaacattattttaaactgaagacatttgagattaaacagatagggaaagaagctttttcagagcttacttatcagactacagcaaaaacttctgggagcgagcctggcataaatctcctttctaggggagtctttactggctggaaagaagatggaaaagaccagttgcacctgcataaacaaaactttcccacagaccttcttatctcccatttgctcccctagaaaccgatttgttcttttcatagaagcccttcctctcccctctctctccgctgtgcagtatataatctcacctttagctgtttgaagagttgcatttttctttgtgcccctgtgcccatgtaggcataaaagtcagttttctcttgctcatctgtcttttgtcagtttaattcctaagctcccccccgccaaaagaatctataagggtagaggaagagcatttcttctctaacatgagaaaatctggccaaaaaaaaaaaaaaaaaacagcctacaaaaaaccagaaaacaaacctactagcagaaacgagttaaaacaatcactaatcacaaaaattcaaatggatttaaatcccataacagttctcaaaccaaaacagactcctagatgggtttcaaaaaatcaaaatccaactatattgtatatacagaaggtagattttaatcaaataatccaaaaggttgaaatgaaaaggatcgaaaaaccatgtctgccaaatgccataagaagaaacagatttagcattgttcttatttcacaaatatagatgaaagacaaaatacgtaaaaagggacaaaatgaatattttatattgattaaaggaaaatttattgagaaaacaaagtgctcatgaataattatgttgcagtgtgactgcaaaaaatacagtcaatgctgatgaaagtcaaaggagaaattaacaaaaaccaggatctcaagaaagggtaagtatgcttacatggaatgaaataaaacagtggttaaaactaacccagaagatatatagaaagatttgtatctaacaaatatttcccaaaagtagtaatattcacaaaaaataaactaagactggaagaaaattcataagcagataaatattactcagaagaaaactggcaaacaaagctgactgttgaaaagtcaggtgaatccacctcaaagtcagagataaggcaaagatgagaaatgttagggactgaatgattgtgtcccctcgagaattagtatgttgaaatcctaacccccaaggtgatggaattagaaggtggggcctctaggaggggattgggtcataaaggtggagtttcatgaatgggattagtgtccttataagaagagacacaagggctttcttcctgtctctgcttatttggccatctgaggacacaaggaggagatgtgtatctgcaaaccaggacagttgccctccccagacatcagatccgtgggtgctttgatcttggacttacaggctccagaactgtggaagataaatgccagaactgactaagacaacagctatcactgctttcaactgccgggtggatgccctagccggagccctatgacagcaagttaaagaaagatatctaaatattacgagaaagaaaaaacactatcattacttccagttggttagtcacctaaaggcagacgcagctgacaaactttgaactaataaaagatttaagaaagaagacaatagctgagctaggtgtgagtgaagaacagtgaagtgaaatggaaagaacagacctcatttacactcatgatgataaccataaaataccaaagaatcaacctggtgcccatgcaccaaacccttctgaggaaaacgataaaaattcaccaaagcacctgaaagagtaaaagagtcaggaagcagcatgtggggtctgccagctctccttcccctgcagctgggccatgtgttggaagcctggagtagcagcagggttactgcctggggtcccagagtcaaggacttagaactgctgtgcccgggctgcctagtagactctagagacgctccgctgcagtcttctggggtcaagaggggacaatcggaaagagctttaaaaactctcaggctgctcagggagttcttagatagtgctttgggctccatgtgcaggatctagatcctgcttgcctggtttgctcttctgattcgatgttccaatatctgctctggctaagaagctgccgagtgattgttaacaatggaaactgcatctttacctcctcagggtctgatacagcaggtgtggagtacagctcaggaatcggtcatacatggtccccctggatcacttgtgaaagactctgtcctgctgggcatgaatgccagcttgcattcctttaattagatggaaactaggaggtatttggtggctggaagtcatgaatttcagcccatacacttccttcaattacatgcttgtctccctcctgctgtccagagaaaaccaactgaatgatgaatagtgctctcaccattggtagctgatagcaaaaaaaaaaaatgatccagaacttcattttgacaaatgaatgcttctccctgatacctagtttgtgcttctcattttcccagggatgcattaatgctagagaactttagtgaatcactacagaattacttatgcattttgtagttaataggcaaaatatgttgtgcctgtaacatagctcctttgatgttcttagtaagcagaacgtagtatggattctactttattgacttccagatggtgcctctaaaggttatgactatgagctagttaaatgttttgtccctaccagtgggttcatggcttcataaagacctgtggtaggtagcatctgagtttgtagtttgcatttatttctgacttttaagtctacattgacacaatctctttatcttggctttgttgaactctgcctcatttattatgaaagctgacttcaggttgagggcaaggcaaagaaagaagccttcgtatttcaaaagaacaagatgggtagccacgacacagtcaaattggttaatttctgttcctcgctccctaaactgctaaatttcattttatatatcttccttcagtccatctacttaatatattttatgtggttagacggactgcatttttcactcatcctgttttccatgggtttttctcatcatcattttaatagtgacataattcatagagatgatactttctagttcaccattgttggatttagtatgtttctaacagattaataattataggtcataagaaatggaaaaaaaattatagggaggtacattttcatattcctcctaatattccccagcagtaacaccttaaataactctagtgtaatatcaaagccaagaaattaacattggtatattccacaaagtttattcagatttcaccagttttacattcatgcatttttgtgtagtatatataattctaagcaaattcatcacatgtattgattcatgtagccaccaacaaattaagataaagaactgttccacgactgtaaagatctcttgcactatacccttatagccacatcccgcttgtccctaactactggcaaacactaatccatctctgtcattgtggcatttcaagaatattttatgtgtagactaatatagtttgtaaccttttgagggtggctgagtagtggtctgtggtatggatgtgccacaatttgtgtaactattaatccattaacagatatttgagatgttttcagtttttcgctattgcaatcatagcttctataacatccatgtccatgtttgtttgtttttgaagatgtttccattcgtctggtataaattacataagcacgcaattgttaggttgtataataagcagatgcttcattttataagaaactgccatactcttttccagagtggccgttcccacctaagtgatcaagtaattccgcatcctccccagaatttggtgttatcactattttttttattttagccacgctagtaggtgtgtagtgataacccattgtgtttttaatttacattctcctggtggctaatgctgttgaacatcttactatgtggtggttcgtcacctgtatatcctcttcattgaaatatatgttcatgtctgtttgcccgttttctagttagattgtgtggggttttgtttgttttatttttactcttgagatttaagagttctttatgctagatatgccttttgtcagatatgtgttttgaaaatatagtttgtctttctgtagtttatctcttcatcttctttacagggtctttcacagagtaaacatgttctttttaaaaattacagtgaagttttttatcaaattttactttgatggattgtgtttttgatgtcaagtcttggaactcatagcctagagtgctgaagatttcctcctatgttttgttctaaaagtttcacatttttaagtcttacatttaagtctgttctttaagttgatgtcaatttttggtatgatatctgagatttacatcaaagtttatccttttgcctgtggattttcagttattccaggtccactcattgagaagactatattcctcttctgaattgctttgaaaaaatcagttgggtatatttgtgtgggtctactattgggttctcaattctgttttattaatctagatatctcttcctctattatagtcttttgctttcatcgtatagtaacgcttaacattgagtagagtgtttcttcccattttattgttccttttcaaaattgttttagctattttagtttctttgtttatataaatttcagactgactttgtgtatccatatgtacaaaactcttgctgggtttttaatgggaattgtgttaagcctacaggttctcgtagggacaattatgttgaatcttccaatccatgatcatggtatgtccctcttatttcaatcttctatgatttttccatcagtattttgtagttttcaacatgtgagatttatgcttgttttgttaaatttatatttgtttcatttttgaccagttgtaaatgatactgcattttcagtaaccacatgtttactgttagtatagcaattattttatgttgatcttgtatttctgaccttgctgaacttactcattaggtttagcagttttttttttaattgtttttgttttgagattcctttggattttccacatagaccatcatgtcacctgaaaatagtaactttttaaatttctttctgatttctaggcctcttacttcctttactttcctggctaggatttctagtattatgctgaattagaatgttaaaagtgaacaactttatcttgtttctgatcttatggcgaaagcatccagtctttcactattaagtatgatgctagctgtaggttttttgtggaattgcttttatcaggatgaggaagtttccctctattccagttttctgagactttttaatatggatgagtgttgagtgttattacttgctttttctgcatcaattgatataatcaggtgatttttcttccttggcatcttaatatggtagattacattgatcagttttcaattattgaactagctttacactcatggaacaaactctacttggtcatgtgtgtaattccttatatatactgctaagttgtattgccaatattttattaagggtggtttatgtatatttatgagagaatgtggtctgtagtttttgttttgcattttataaattttttctactgtctttgtctagttttggttatgaggttaataaaagcctctgtgttttatccttttttatttactgggagacagttatagaattgatattaattcttccttaaatgtttgttaaaattccccagcgaagccattcaggatgtggagatacctttttaaaaaacatttaaaattatgaactcaatgtgtttaattgttttagggatcttcagcttatttatagcctattggttgagttgtggtagtttgtacttttcaaggaattggtgcatttcatttaagttgctaaatgtatgtgttaatttctatgtaaagagttgttcatagctttcctcatcattcttttgatgtctacaatgtctgtgtagtgacacatagaatacattcgtggtattagtttgtcaattttattgatattttcaaagaagattttcatttcattgatttttttttcttttttttctcttctccgtgtcagtgattttatacttttatatttattatttacttccttctacttgtggggcttgtcttctcttttctagtttcttaccgagtgagcatagatatagacttgaatctttttctctttcttaaaataagcagtactataaatttattcttagcactaccagcatgtcatacatattgatacattgcatttttattcagttcagtgtatttttttccatttccttgagactttctctttgactcatggattatttagcaatttggcattcagtttccaagtgtttggagattttcttgtcatcttaatgctattcatgtctagtttgattccattgtgggcaaatatcacactttgtgtggtttcacttcttttaaatgtattgaggtttttcttaggctcaggatatggtctatcttggtatatgctccatgagtacttgttggtagacagtttcctaaatgccaattaagtcctgttgtttgatggtgtaagttcttttatatccttgctgattttctgtctagttgccctgtcatgaattattgagagaggagtgttgaaacctccaaatatagttgtgaacttgtctatatcttttgaaaatttccatcagttctggggtcatgtattttgaagctttcttgtttgagaaaggatttatgattgctgcatcttcttggtagactgagcttttatcattatgtaaatttatatctatctttcataattttcttttctctaagatctgctttatctgataataatatagttactcttgtgttttttgagtaatgtttgcagggtatgtgtgtctgtgatatatatatattatatatatatattcttcgttttttctttcctgcctatgatgtacttaacttttttttagaatttcttttttagaatttttagaatcttttttatttatagtgtttttgagtatgtctctttgtacacctatttcatggttgctcttgatattacattttatgtatgtaacttattacgttactgactactgatataaacatcttactggttcaagtaaagtagataaattttctcttccttcttttattgtttttttctctctttcaagaacttccttgagccatacttcttgggtgattctgctggtcactatttctcttagttttttcttcatctgaaaatgtcttgacatttcttcattattcctgaaagatattttaactggatttagaattttgagtgtacagtaagttatttcagcattcggaaactgtcataccacctcctgctggtctccgtggttactgttgaaaattctgctgtcatttaaatttgttgttgttgtttagttttgtttttcccccttacggatcatttttctctggctgctttcaagattttctctttgtgtttaatttttagatgtttgattatgatgattcttggcattaatttttttgtatttatctggtttgggttttactcagcttcttgaatctgtagatgtatatcttttgctaaatttggaaaatttttaataatttcttcaaacatttttcattctcattttctttctcttctttttctgagactctcatgacacaaatatcagattttgttatggcttcacacccctgcaggctgtgtcgattttttttcttttttttggtctattttacctttgttgctccgattgcataatttctattctgtcttcaagtcagattctttcctttgctatctccactctactattgagcccagcctacatgttggtaatcccagttactgtatttttcagttctaaattttcatttagtttttctttatatcttctatttatttgttgagactttctattttttcactggtttcaaacatgttcttaattgcctaccaaagcattattatgattgaggttttaaaatccagagaattccaactttctgaattatctgttttggcatctgctaattttctcttctcattaaagttgaggtttttttcttgattttggtattacaggtgatttttaaaattatatcctggacattttgggtattattgtttgagactccaagtcttatttcagtgttccttttcactagacctcctctgacactgtgctagcagaggagggaggacaccacccctgctgtcgtgtggttcaggccccccactcagcctctgttgacacctgggagggatggggaccttggtactgctaggtgggagtggaagtccaggctccccaagtgttctccactgaaacagcaggaggcggctgggtcaagatgaggtcactgcttggccttctctgacatcacctcttgcaagtatggggaggagtgtctcccttttgcctggggatgtttgaatctagagtgctccctgggcctttgctgatgaggctgctggtggagtccagctttttcctttggtgtttccctggggcagcgctcttggctagacacggtccagctgtcaggctgcttctctcctgaccatttggcgagagagggcaagctttcctcaggacttctttggtctgtacctgttggggtttttttggtgcattcttctccagaacccagtttggaataggtaagataaatagtaaacctagggatgtcagcaccatgccgttctgcctgtcacaaaggtgtgatcccttctgccttcttctctgaactgttgacagccttcttatgtttatttatggattatgtgaagacttcttagtcatatttagcaagagtaataatgattactcaggtcagcctgtcataacaaaataccatagactgggaggctttaaataatagaaatttattttcacacaattctgggagctgagaagttcaagatcaagggtctggatttggttccctgaagagaactctctctggtttatggcttccttctcattgtgtccttacatggcagagagaaagagagagggagtgggagagggagagagaggggcacgtgctggcttccctcttcctataaggccaccagtcctatcagaatagggctctacccctgtgacctgatttaaccctggtcagctcttgcttatcgtttttagccgtattacctccttatcgtttttcttgtatttatgctgtcatagcaagtggcatttttctgaaagcatatgcttagtttatttagactttatatttattcagattaaggttggtcaatttcttcactcaatctgaaggaaaagctctttaaaaaatcagcctgatcatttttcaatgaacctctggtgtggactttgggcatccgattgtgtaggaggctctcaaggctggctgtttgcccagtcagcattgtcactgggggacgagctggcagggtgcaatgttgttcccttcacctttgtgtctccaagtgaccctttcctcatagggatgaatttccacccatgatgaatagtccttgtgtgcatagtaatcccagtgtcagaacatcttctccttccactgctggggataattagcttcctttttcttttgtttcatacatctggagccagaaaaggcataacaggtcacatagtttagaaatggacatactttttaaaaaatttcatgagctccttcacgtccatttatctaggctacgtaaaactgttagaaggaatgcccaggctacaagctataagcaggcaggagggtggggcccgtggagcccagctctctcccacacgaggccctgggagttcagtcaaccatcctgggtcgcaaaagtcattacccaagaaggcgggagtaaaactcgtgcttctgccctcttgccctgtacgaggtgggttggaactgagaaggccaggaccttcaaaatgctgcattctccctgagaagttggaattgaaaaaaataaaatctaccatccagtgcaagacgatgaaaaagaagcatgactgttttaggctgtgctcagtcagggctcagagtcttccatgggaattcacaacagatgagggaaggggtgcctcctggtgctggtttgatatgtccagcagaacccaggaaattccagcaccaattgtagtggcatgcaaagtggtctgatctgtgaggctctgggcacctggcagaatggagtgcagggcacctggagagaagtccccctccggccaggtccacaggatctccatagacacggtagcaacacaggttggggattcattccagtatgtccagtcagcaaggttcatgtgccatgaacatgctctgcagatggtgattggggtttgagacatgggttttctgcagcctgacaaatattccatgctctgataagtgtccaggtgtgaggccaggtgtgcaggcaatgctgtgagagggcagccaagggctctgcccctttctctcctgcgtcctcctccctccacatccatcctgtcccacccctgtgactacatgtgggtttttttgtgtgttttttttttttctgagactgagtctggctctgtctcccaggctagagtacagtggcgggatctcggctcactgcaaccttcacttcccaagttcaaacaattcttgtgccttaacctcctgagtagctgggattacaggtgcccaccaccattcccggctaatttttgtgtttttagtagagatggggtttcaccatgttagccaggctggtcttgaactcctgacctcaggtgatccgccctcctcggcctcccaaactcctgggattcaggcgtgagccaccacacctggcctgcatctatatttttaagctcttgtgccatttagccttcattaatttttttaagaaaacattacagatgaaaactgtatgaggaatgaaacactataagaaataatatggaaactcaatttttaaaaatcagctaaaaatgaacttcaaattaaaacacatacagaaacatctcactttgagcaagcattcacaaacatagcaaaaggcaggtttggactcttaaacacttaagacaatagaaactgacaaatgatttgaaaataattacactcaagtaagaattaaaaacacaaatgagagaaaccctttaaaaagcaactttgaaaagaatcaagtaaaattaagagagatgagaaataatatagccatcaaaattaaagacagtggaggcatagaatgtcagatgagacacagttgaaggagcagaggcagtttcctgcgtgaatcatagaaagctaaatagatggaaagtaggaaagaatgatttacggtcgtgcaataatatccaacacttctgtagtgcttctgtgcaccaggtcctgtttcaaatgctttacatatattaacaaccttctgaggaaagcgctgtgattattttcagatatgacagctggagcacactgtggccaaggtcatgcagaaagcaggtctggaagcctgcaccccccaggagaggctgtgcctgacaaggagggctgcttcctctcatgccggggataggtgctcccatacacactggctagaatagtagaaggcaataataaattgcatgtgggagaaatattaaaagattattttcagaaaacaggtaaagttatggctcacatacagatataaaaatgagcatgttgaagaatctatttgactcatatcacatgaggaaacaaagcagatgttctcagttcaatgggaaagtcaaactagtacaaatttatatagagtaaaggaatttcgagatgaattctaaatggacacagaacttgtttatctaaaggggcaggaagtcaaggcactaccaattaaatcactactgggcgactgagaacttccgcatctatcagctgcttacggtccgcgcacagtggcaaagcagctcagacagtgaacagggcgagacttgctaagtgagatctatgtgctgtaggggacacatcgttttccattgaaatacaatgatttttttcaacagaagccatgtcccaaaagaacagctgaggatgtaataatattgatgaaaaacatacatcctcagcttcaggagataaaagtctgaggaaagatatgtgataggaaatgagcccaagacatattgtgcaaaaaagctgcaggaatgtccaaagccaaaaaaagatcctagaagcgatgagagaaaaatagatagcttgctaacaaagagatggcaattagactgactgcagaccttttaaaggcaacagtagaagccagaaaaataaacgaaaataacgtcttttaagtatgaaaggaaataattgtcaacctagagttttatcctgagctaaaccattctttacctgatgggcaaaatcaagacattctcgggaaaacatatactaaaggagtttaccgtgcaggggctgtgctactattttaaaaaactaccagaagacgtttaggaactaggcatgagaagcagtgagcgaagcaattggcaaagattcaggtacatgtaaacagatttggttatataaaataataatgatgaatttgagagtattaaaaacaaagtgggacagggcgcaggggctcatgcctgtagtcccagcactttgggaggccaaggcaagtagatcacctgaggtcaggagttcgagaccagcctggccaacatggtgaaaccccatctctactaaaaatacaaaaattagccgggcgtggtggcatgtgcctgtagtcccagctacttgggagggtgaggcaggaggatcgcttgaacccaggaggcagaggttgcagtgagctgagatagcaccactgcactccaacctggaacctgagtgacagagcaagactccatctcaaaaaaaaaaaaaaaaagatggaattaaaatactggaaaatatagcatgaaatagtaacttggacagtgcttggaggtaaaaccctcaggtgtacttatatgactctggaaggccatggagacgtcagctttaagtgaaatatacaaggttaaagtgtgagaataaccaccagaccagacacattaagaatactatatttaacttccaaacaagtaggggtcgaatggggaagggatgaagaaaacaggagaaggccggcgcggtggctgacgcctgtaatcccggcactgtgggaggccggggcgggcggatcacgaggtcaggagatcgagaccatcccggctaacacggtgaaaccccgtctctactaaaaatacaaaaaaattagccgggcgtggtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaagaaaaaaaaaagaaaacaggagaaacctaaatgcaatccaaggaggaagaagtcaaaagcataacattagatggtagaaatgaaaacaaatattacagtagacaagataaaagtaaatgggatggccagctggttaaaacacagatctccccaatatatctctatgcatttaaatcgaacgatagactgtttagatgaaactaaaccatatatacgtaaaggatgaacgcaaaaaaggaaaaacaaaaacaggaacaaaaataaaatgtgagtggctatgtttacaacaccccccccccacacaaacacagtaagaaaaacaagtataattaaggttaaataaggtcaggtgatagtgattttttaaaactaaggatatataacaaatcttacatgtatatatctaataaaattgctttgaagaaaaattggtagaatttaaagtttactggataagtccacaattacagtagaagattttaatgtacctcttttagtaattgatagtgtaacaaggggaaaaaaaatgtaagtatgtaggagttttgaacaacacagttaacaagtcttacccaatatatagatatagatacagatatagaaaaaatgcatcctcattccactagaaaataaatatatggaaaactggatatctaaatgtgaataaaaacatttagcatgtgtggtgtgagtttgtgtgtgtacgtgtgtgtgcacacatgcactcacatatgtataggaatgcaggcagacatacatagcctttaaatgcttatgttagaaaagatacttgtctaagcatctttaccatatgatccaacaattgtcctcctcagtatttacccaaaggagctgaaaacctgtgttcacacagaaacctacacacatatgttgatagcagcatagacatcttttttaggaaaccctaaaggcttttaatatcttttttgggaaaatgtgtgagataattaccaaactcaagaagttataaaatataacattaactccaatgaaaaaaagaaggaggaataaagataaacctagaaatgtattaaataagaaaactaaaatagagatcaacgaaggacaaattggttttaaaaaagaactaataaaatcaacatacctcaggaaataattaccaagaaaacaaagaaggcacaaacaaacatttactggatataaaaggggttttcaactacagaaaaatacttaaaaatagaatattgtgacacaattttatgccaaaattttggaaacttagatagatttaatattttctagaaaaatagaccaaaaagggaatagactagcaaaaaaacagactttgttttttaaagcagtttgaggttcatagcataactgtgtggaaggtacaagttcccatgtcccctcccaacccccacccaagcacagcctcccccatcatcaacatcccccaccagggccgtacaattgaaatagatgaactgatgcagacacatcattaccacccagagtccatagtttacatcagggttctctcttggtggcgtatgggttctgtgggtttgcacagatgtataatgacctgtatcgaccattatagtatcattcagaatagcttcactgccctaaaaatcctcggtgctccacctattcatcccgccctctctctgcaatccatggcagccattgacctgttatgttttgttttgttttgttttgttttgttttgttttgtttgagatggtgtatcgctctgtcgcccaggctggagtgcagtggtgcgatctcggctcactgcaacctccacgtcccgggttcaagcgattctcccacctcagcctcctgagtggctgggactacaggtgcacgccaccacgcctggctaatttttgtatttttagtagagacagggtttcgtcatgttggccaagctggtctcaaactcctgacctcgggtgatccacctgccttagcctcccaaagtgctgggattacaggcgtgagccactgcgcccggcctgatctgttttgctgtctccattgctttacttttcctagaatatcatataattggaatcttacagtctgtaatcttttcagattgacttatttcatttggtaatatgcatttaaggttcctccatgtttttttcatggcttgatagcccatttctttttagcactgaataataatccattgtttggatatagcacagttagtttatccatttcacctactgaaggttgcttccaagttttagcaattatgaataaagctgctatcaacatatgtatgtaggtttctgtgtgaacacacgttttctgctcctttggataaatacaagggaaggcaattgttggatcacatggaaagagtatgcttcgttttgtaggaaactgccaaactgccttccaaagtgactgcaccatttctcatgcccaccagcagtgtatgagagttcctgttgctctgcatccttgccagcatttggtgttgtcagtgttctggattttggtcattctaatagatgcgtagtggtgtctcagtttttttttttttaatttgtattaaatatgacaatgtggaacatatttctatgtgcttctttgccatctctatattgtctttgctcaggtgtctgttaaggtctttggcccattattttaattggattgtttgttttcttattgctgagttttaagagttctttgtatattttggattacagttcattattagatgtgtcttttgcaaatattttctcccaatctggaggtcatcttttcattcttttgatcagtatatttttaaaaaagaaattcaaaaaggtaggtttacaggcaagttccacccagcataaaatatcattatgaacataaatgtataagccttttttattattatactttaagttatagggtacctgtgcacaatgtgcaggtttgttacattaggtgtacatgtgccatgttggcttgctgcatccattaactggtcatttacattagatatttctcctaatgctatcccacccccagccccccaccccccgagaggccccggtgtgtgatgttccctgccctgtgtccatgtgttctcattgttcagttcccgtctatgaatgagaacatgtggtgtttggttttctgtccttgtgatagtttgctgagaatgatggtttccagcttcatccatgtgcctgcaaaggacatgaactcatccttttttatggctgcatagtactcatggtgtatgtgtgccacattttcttaatccaatctgtcattgatggacatttgggttggttccaagtctttgctattgtgaatagtgccgcaataaatatacgtgtgcatatgtctttatagtagcatgatgtataatcctttgggtatatacccagtaatgggattgctgggtcaaatggtatttctagttctagatccttgagaaatcttccactgtcttccacaatggttgaactagtttacactcccaccagcagtgtaaaagcattcctatttctccacatcctctctagcatctgttgtttcctgactttttaatgattgccattctaactggtgtgagagagatggtatctcattgtggtttggatttgcatttctctgatggccagtgatgatgagcattttttcatgtgtctgttgtctgcataaatgtcttcttttgagaagtgtctcttcatatcctttgcccactttttgatggggttgtttttttcttgtaaatttgtttaagttatttgtagattctggatattagccctttgtcagatgggtagattgcaaaaattttctcccattctctaggttgcctgttcactctgatgatggtttcttttgctgtgcagaagctctttagtttaattaaatcctatttgtatattttggcttttgttgccattgcttttggtgttttagtcatgaagtctttgcccatgcctatgtcctgaatggtattgcctaggttttcttctagggtttttatggttttatgtcttaggtttaagtctttaatccatcttgagttaatttttgtataaggtgtaaggaagggatccagtttcagctttatacatatggctagccagttttcccagtactatttattaaacaggaaatcctttccccatttcttgtttttgtcaggtttgtcaaagatcagatggttgtagatgtgtggtgttatttctgaggcctctgttctcttccattggtctatatctctgttttggtaccagtaccatgctgttttggttactgtagccttgtagtgtagtttgaagtcaggtaatgtgatgcctccagctttgttgtttttgcttaggattgtcttggctatgtgggctcttttttgtttccatatgaactttaaagtagttttttccaattctgtgaagaaagtcattggtagcttgatggggatggcattgaatctgtaaattaccttgagcagtatggccattttcacgatattgattcttcctatccatgagcatggaatgctcttccatttgtttgtgtcctcttttatttcattgagcagtggtttgtagttctccttgaagaggtccttcacatcccttgtaaattggattcctaggtattttattctctttgtagcaattgtgaatgggagttcattcatgatttggttctctgtttgtctgttattggtgtataggaatgcttgtgatttttgcacattgattttgtatcctgagactttgctgaagttgcttaatcagcttgagatttttggctgagacaatggggttttctaaatatacaatcatgtcgtctgcaaacagggacaatttgacttcctcttttcctatttgaataccctttatttctttctcttgcctgattgccttggccagaacttccaacactatgttgaataggagtggtgaagagggcatccttgtcttgtgccagttttcaaagggaatgattccagttttggactattcagtatgatattggctgggggtttgccataaatagctcttattattttgagatacgttccatcaatacctagtttattgagagtttttagcatgaagggctgttgaattttgtcgaaggccttttctgcatctattgagataatcatgtggtttttgtcattggttctgtttatgtgatggattacatgtattgatttgcatatattgaaccagccttgcatcccagggatgaagccaacttgatcatgatggataagctttttgatgtgctgttggattctgtttgccagtattttattgaggatttttgcatcaatgctcctcagggatattggtctaaaattctcttttttggttgtgtctctgcccagctttggtatcaggatgatgctggcctaataaaatgagttagggaggattccctctttttctattgattggaatagtttccgaagaaatggtaccggctcctctgtacctctggcagaattcggctgtgaatttgtctggtcctggacttttttgggttggtaggctattaattattgcctcaatttcagaacctgttgttagtctattcagagattcaacttcttcctagtttagtcttgggagggtgcatgagtccaggaatttatccatttcttctagattttctagtttatttgtatagaggtgtttatagtattctctgacagtattttgtatttctgtgagatcggtggtgatatcccctttatcattttttattgcgtctatttgatttttctctgttttcttctttattagtcttgctagcggtctgtctattttgttgatcttttcaaaaaacccgttcctggattcattgattttttgaaggtttttttgtgtctctatctccttcagttctgctctgatcttaattatttctttccttcagctagcttttgaatttatttgcttttgcttctctagttcttttcattgcgatgttaggatgtcaattttagatctttcttgctttctcttgtgggcatttagtgctataaatttccctctacacactactttgaatgtgtcccagagattctggtacgttgtgtgtctttgttctcattggtttcaaagaatatctttatttctgccttcatttcgttatttacccagtagtcattcaggagcccgttgttcagtttccatgtagttgtgcagttttgagtgagtttcttaatcttgagttctaatttgattgcactgtggtctgagagacagtttcttgtgatttctgttcttttacatttgccgaggagtgttttacttccaattatttggtcaattttagaataagtgcaatgtggtgctgagaagaatgcatatcctgttgatttggggtggagagttctgtagatatctattaggttcacttggggcagagctaagttcaaatcctgggtattcttgttaaccttctgtctcgttgatctaatattgacagtgggctgttaaagtctcccattattattttgtgggagtctaagtctctttgtaggtctctaaggacttgctttatgaatcttggtgctcctgtattaggtgcatatatatttaggatagttagctcttcttgttgaattaatccctttaccattatataatggccttctttgtctctttttatctttgttggttgaaagtctgttttatcagagactaggattgcaacccctgctttttttttgcattccatttgcttggtagatcttcctccatcccttcattttgagcctatgtgtgtctctgcatgtgagatgggtctcctgaatacagcacactgatgggtcttgactctttatccaatattctagtctgtgtcttttaattggggcatttagcccatttgcatttaaggttaatattgttatgtgtgaacttgatcctgtcattatgatgctagctgattattttgcctgttaattgatgtggtttcttcatagcatcgatggtctttaccatttggcgtgtttttgcagaggctggtaccagttgttcctttccatgttaagtgcttccttcaggagctcttgtaaggcaggcctggtggtgacaaaatctctcagcatttgcttgtctgtaaaggattttatttctccttcacttatgaagcttggtttggctggatatgaaattctgggttgaaaattctttaagaatgttgaatattggcccccactctcttctggcttgtagggtttctgccgagagatccactgttagtctgatgggcttccctttgtgggtaacccgacttttccctctggctgctgttaacattttttcccttcatttcaaccttggtgaatctgaaaattatgtgtcttggggttgctctttttgaagagtagctttgtggtgttctctgtatttcctgaatttgaatgttggcctgccttgctaggttggggaagttctcctggataatatcctgaagggtgttttccaacttggttccattctgctcatcactttcaggtacaccaatcaaacatagatttggtcttgtcacatagtcccatatttcttggaggctttgtttgtttcgttttactgttttttctctaatcttgtcttctcacttcatttcattaatttgatcttcaaacactgatatcctttcttccacttgatcgaatcggctattgaagcttgtgcatgtgtcatgaagttctcatgctgtggttttcagctccatcaggtcatttcaggtcttctctatactattcattctagttagccattcatctaaccttttttcaaggttcttagcttccttgcaatgggttcgaacatgctcctttagcttggagaagtttcttattgccgaccttctgaaacctacttctgtcaactcgtcaaagtcattctccatccagttttgttccattgctggcaaggagctgcgatcctttggagaagaaggggtgctctggtttttggaattttcagtttttctgctcttctcctcatctttgtggttttatctacctttggtctttgatgttggtgacctacagatggggttttggtgtggatgtcccttttgttgatgttgatgctattcctttctgtttgttagttttccttttaacagtaaggcccctcagctgcaggtctgttggagtttgctggaggtccactccagaccctgtttgcctgagtatcaccagcagaggctgcagaacagcaaacattgctgcctgatccttcttcttgaagctttgtcccagaggagcacccacctgtatgaggtgtctgttggcccctactgggagatgtctcccagtcaggctacacgggggtcagggacccacttgaggaggcagtctatccattctcagagcttgaacgccgtgctgggagaaccagtgctctcttcagaggtgtcagacagagatgtttaagtctgcagaagttgtctgctgccttttgttcagctatgccctgcccacagaagtggagtctatagaggcagtaggccttgctgagctgtggtgggctccactcagttcgagcttcctggccgctttgtttacctactcaagcctcagcagtggcggacacccctccccaccaccaggctgtagcctcacagatcgatcacagactgctgtgctagcagtgagcaaggctccgtgggtgtgggtcccactgggccaggcacaggagggaatctcctggtctgctgatcgctaagaccgttgaaaagtgcagtatttgggcgggagtgtactgtttttccaggtacagtctgtcacagcttcccttggctaggaaagggaaatcccccaaccccttgcacttcctgggtgaggcgacgccccaccctgctttggcttgccctccgtgggttgcacccactgtccaaccagtcccaatgagatgaaccaggtacctcagttggagaaatcacccatcttctgcgttgatctcgtttggagctgcagaccagagctgttcttattcggccatcttggaagcaactcctatgtataagtcttaactaaaatatcagcataacaaagtctagcaataagttaaaaataaatcctaacaagtttaggcttctattaggaatgcacagtttgtttaactttcaaaaaagtccattaatataattcattctattaaaagattgaggcagaaaaaaataaatgatcattctggtagctggagaaaaatcagttgatgttatttaaaacccatttgtaattggaagaagtttcacctaacctgacataggggtctcacttaatgctgaaacattagaagtttctaaacgtagaataaaataagaatatcagtgtcatcactttttaaaaatatcttagtgactatatgaatttcagtagtaatacaagtaaaataataaaatgtttatgaataaggaataaacctgttatcatctttataggccatatctgttttttacatagaaaatccctagagactgtctagaaaaaatatatctgatacaaaacaagatctatcgaagtatcaaatgtgtttctatattcttacaacagacagttagaaaatgtaatttcacaaattttattttcaatatctgcaggtgttgagtaccaaaaaataaatttaagaaagaacaacataaatgttgagttgtatcacgtttatgcctgggaaaactcaataccagatgccaaatttttccaaaataaattgagtgtgattaatgtgattccaactaaatttaatgtgattccaactaaagtcttaacagggacttcatgagactgtacaagtaaatttaaaatttacaatgatgagcaaaggatcagtaatgagcaagaatagtaaaacaagacaattttaaagaaaaagaaccaagttgggggactttctgtgccaaatgcaacactttcataatgctgtaaggattaagatgatgttttgctgggtcagggatagacatgtaacacaaggaacaaaaatagggagtccagaaactggatatctgctgtgttaatcttctcccatgttacttatagctttgctgtaatccgtcctatgccatatccagttgttataatatcccatgttacattcaatttaatatgccaactagtggctaaagaaaagatttctgagtgggagctaaacactgggtactcatggacataaagatggcaacaacagacactggagactactgtagggggaaaggagaagggggccaggattgaaaaactactggatactctgctcactgcctgggtgatggaatcaattataccctaaacttctgcatcgcatgcgatatacccatgtgacaaacatgcacatgtatgtcctgaatctaaaataaaaatcaaaatatgaacagatagcacgtgcctgcagtcctagctgccaggaggctgaggaaggcggatggcttgagcccaagagtttgaggctccagtgagccacgatcgcaccactgcactccagcctgggtgacaaagcatgaccctgtctcaaaataaataaataaacaaataatataaataagtaaatattttctttttttaaaaaaaggaaatattcttgaatgcatttttctggaagcctcctcctggtacctcagaattctgcttcctggaatctctggcaggtagaaatgaccataaaagtttgattctactcaagacttttttggtcatggactatgacaagccacattgctgattgcagaccctcaacattttagaataaaatatagaactaaaaagatttatgacagggtgtgtctctccctctgtcttctgttcagaaaatttacccattctcaacagccttgctttccctctgcaatctgggcattgcttccgtcagtggtgtcttcacatggaattggggaattggcagctttttttcccctttcttcagagatttaaagtaaatgacaccttagatcagatagatgagcatcatccttcctcctcccttcctttttggatagatttcatcttcatctctcttgcccttctctctctcagtctttcaaggttgctgagagctcagagggaatgggattgatttcacatgagaccttactatttagggtcatcctgaacccatgcgaagcattttctttgcagcaggacagagtgcctggatttcttcttcttattgttattttattattattcatctttacctgaatgcagaggctcattctggtgaacacgtgccctattgggagttggtcttgctggacttctttgatggctggacccctggctttttctctcaaggttataagagccgggcttctgggtcagatgatgctttctctgtggaggcacaatcactctcttcttttctggctcagtgttgaggcctcccgtgctcagccgtagaggtcaatgctacagagctgactgaggcaggaggcaaggctgagcctaggatcagagggctcttgttccagggccagcagctctgcaggaatgagaccaggcaccattgtgtgaggatcctaggggatgtggaggaaggaaaggtgtgatctcagacccacccacagggtccacctgtgccccatgggctccccctgcctatactgccattgacgtctgaaagcacagcttgtaatcccataaggattgggcttctgaatcctgcctggggggccaagcagtggtttgctcccaagccctctttcagcctcactgcttagggcaacatggtgtaagcaaacaccatgatccaggcaagccagaccttcctggagcctccttcgttctggcttatctccaagtgtgtgatcccaccatgccctccgccaggggcctgtccacatccgtttccgtctttgggagctctggctatcctttaaagcctatgcagacacctctcctcctcctacccccgctaaggacacgtagcttgcgtcctacatgtttgagttacatttgccccagtcaccccctccgtggtgagggtagggctcagagctctcctcacaccaagagtgggccccagtcattgctggctgggggaggacaaaggcagccagataaaggcagctcctgcaaggacggagaggccacaggccggcatcttcacaaactgtggatgtactgtgtcttccagtagtcaaaataaagaatatatttggccattttcagactatttaatacagaacagtttacacacagaagaggagtgaggaggagaatgaatccctgcagccctacccctgtttccacggttatgggtgtttgccagcacagggctgcccagcactggtgagggggtcactgttggctggcatctgtcgggcatccccggggaagctgcgccggtgctgtggccactgaggtcctcataggggttctggccactcacatttccgaggttcttcatttcccacctcagatcactgttttcaaactcagttttcagcaacagggcctttcttcaaactcatcttatctccacccctaatgctcaaaacagataaagtagtattagcacaaatccattacaagagtttacttttatactatgtacttataaaatcaatttgcctatgggaaagaagcgtaaaactaccatcatgggtattaagatttggattttgataacatttatgtgttacaatttcatgtagctcaatattctgtttggatgaaaaacattcagaaatcactgagtcacaaatcactgagtcacaggtaagctgttgctaatagcaacagtttttttatcttgtttttacctgtttgccttgtgatctcaagagtctcttcaattaaattgatccaaatgcttgaaagaaaggcttgtaggaactttttttttttcagagttgaatcactgatctaacagatgctcagtcttgattataaatatgaaaatcagacaggaagaaacccaagcttaaaataagcaaaactttgttccccataacatgcatcaaaccacactattcttaatttttaatttatttttatttcaaaaatatttatgtttttattttattttattagagacagggtctcgctctgtctcctaggctggaggacagtggtgcaaacatagctcactgcagcctcaaactcctgggctcaactaatcctcctgcctcagcctcctgagtagctggaaacataagcttatgtcactgcactgattaattttgtcagtgttttgtttttgtagagatggggtcttgctttgttgcccagtctggtctcaaacttctggcttcaaatgatcctcccctctgggcctcccaaagtgctaatattataggtgtgggccactgtgcccagactatagaccatgctttctatgttgctgctactgagggtgattgatgggggaacgcatcccacgtctggtgcgggttagatgccatgtaattggagggacagactttaattttttaaaagcaatgcaaagctgaaatctcatttggtgactcctttataagagattcaaatgcgtgcaaattcatggccagagaggctttagtttaacttccatgcaaaaaggagttaaacaggacacataaattaacacaacggtagtctctaagagttaaaattttgttaatagtcatttgagtgtgtgacttttattaccattttcaaattcaaaggaactaaaatattggaggtaaatatttccagaaaccttgaggcgcctccatagggtctcagggctccagagaacctagcttgaagatcatgatactatccagagtgagcttgtgcaggtccacattttcagctattttgtgcccaatcaccatttataatgtgactcattaacagtcagatacagactacggtcaagcaaagaatatttacatcttgatcctacctcctcctctctctttccctatgtgtttttggaagtaagggggggggatgtgtcctttcatgacaacttggctctcgccttctctccctctctcctttctctcagtctccccctttttcccccttatccccctttcttccttcccttaaacttcatcacgtttttgcttgtttcatattcaaatcacggctttctcatacaattactacttttttcctagagtttctggttgccttttcttattataagaatgtttaaaactgtgtccttaatcaagtccatgatgtttttcagctcattatatctcctctttcttgctctgaacccatttggttctgtcctcagtactttaacatcttgctgggatttggacccacctttttctaggcctcctgctcaagtcatcctctaaatctcttttatcgatctccaggtttaatctaaaagtgtattctttctcaggtttcactctcattgttccaaagctgaccaaggaaatatatgttgggaacaagctcttcaaggctttaatgttcttgaaaacccctttttttttgccttcatgcttgggtggtttttctgctgtgagaagtgtcttcgtgttatttcttaattttttccctcccactctccctgatggagcttctgtgagtgaggcgagttcccccagccttgtcctctacgctgtcttctttctgtgttacgtttgatctctgtgatttctatcagccaaacctcccacctactcataaaaagttatttcataaatcatacctttaatttccatttttctctcttttttctaattgctatatcctcttgaatgttgtgaggacattacttttttaagaagtgatttttccttcttttcattgactcattctttttggatcttttttggtgtgtatcctccactgtgtgtcgcatgctgaagactgtcctccggtatctgtgattctaagtttccccttgagaaatctcagacatgggagaggctgcctgaggctctgtagtcatgggcagctcctgcaggggccatagtggccaaaatgaggggagctttactctggggtgctggtactttgactggctgcctgtgtttttttgaggtggtttatttttctttaccagtagggctgtgttttaagggtacccagggttggttttaatcaggcatggtgagacacttagacacagaagtgactgtcctgaaggaaagcagttttactcactgttcttagaagcagaaggacaggctaggcgcggtggctcagcctgtaatcctagcactttgagaggctaagtgggggtggatcacgaggccaggagttcaagaccagcctaaccaacatggtgaaaccccatctctactaaaaatataacaattagccgggagtggtggcacgcacctgtaatcccagctactcaggaggctgaggcaggagaattgcttgaatccaggaggcagaggttgcagtgagccgagatcgtgcccctgcactccagcctgggcaacagagctagactccatttcaaaaaaaaagggaagcgtagcacatgcagggacacagggaggcaccagggccacgcgggaggccgagagagtgcgggaaacctgagcaagggccgtccttcattgtggcttctgcaggaaggaagggaggagcagggcacgcaggcttaggtttaggattagctccttagaataattgcagtaggccctggggcatagggactcttcctggttgacttttacctggtcctgcagtgatgagagcaggactggtgtcaaccccagtgtgacagcctgataaaggatgtgtttgggtgggggtatgggttctggattgattgatttgtgtttgaaaggccagagttgtttactatctctccaaggggcctccagagtcagcaaagccccagatgtcaacacatcagaatccagaaaataaaagacaaggctagtacaggctgttggtgtaattgctgttggggctgtgtgtgtgtgggtgtgtgtcctttatcccagttgttaactcctggctgcaggaggctggaacaggggacggagaggggcagtggtgcatccgtctaaaactcgcacttacttctgttgtcttccctcactctccttcttttcatcgctaactgtggagctggaagccctctggggttgtggtgtccagctccctcctgcacctgcagttcagtcattcaagatatatatgtgggccgggcacggtggctcacgcctataatcccagcactttgggaggctgaggcgggtggatcacaaggtcaggagatcgagaccatcccggctaacatagtgaaacccccgtctctactaaaaatacaaaaaaattaaccaggtgtggtggtgtgcacctgtagtcccagctactcgggaagctgaggcaggaggatgacatgaacccaggaggtggagcttgcagtgagccgagatcatgccactgcactctagcctgggcaacacagcaagactctgtctcaaaaaaaaaaaaaaaaagatatatatgtgaagcacaaaccaagtgtgggtccgcttcaagaggctggaactagagctttggacacagcgagtgaaaaccctgccccatgaggctcacagggtggcagcgtgcctcacccaccctctgttcttctagacaccatgaaaatgtcacatctgccgatgtcctccagagttgtttacaggtttcatttggttaagagcttggttttatatacattgtgagaaaaatcaccagttcggtgtgaaaattgaaatgggggtagacactggcccttccaagctgtgcccggggaagacctcccaggccagtcccagtggtgctctcaggcagcgtgtggggttgtgaggacagacaggggcccctctcaaggtctttgctgctccatcaaagacagaccccagggcttcgggaaatccacagcctggtggcactggctcatgcagtccttttcctgtttctagtgctgatgagcgctttgacgccacattccacactaacgtgttggtgaattcttctgggcattgccagtacctgcctccaggtaagctgcacctcctttgtcctcttccagttagaaaactgaagcgagtttgggtgtcagtcagtctggccggtgcccccgtgtggtggaccagctctttgcttcgcctttgctcactcccacctcttcctctctcttctcttctgtgcttctgtgtgctttctacccccagaagtccatcctcctcttttgtctcaatcaagccgtctttgccactatgtccttattttctgccatgtgtgccttaaagccaatgtacaaatacagcgagtctcctttgccgggcagtggccacctcaccttccagcctggcaagccacctctccaggctctgcttctcagttccagcttgccatcctcctccctgcgggactcagtgtcttggcaggtgcagcgctccagctgccgggggtgagatatgacagttccaggatcctgagtgcgtgcgctaaagagcacacgcaggttacaggcaaggtctggtggtttcaagggagagctctctagcggctgacttcttcccaacagtgtctcacctccaaggctaagtgctccctggattggttctttcccaccagtccatcttttcagtcgattcacagggcaagggaaatgggtttatggcctaaaggtgcatgcagagtgcgcactagcatattgataggaacagctggggtttttgatcttttagaagatttttaatgtgtttattccagggtgatctcccacactgcagctgtttaactttctgctcagaggcaacctgcaattacctccacacctaactaccactcacacatacgactcacacacacaccactcacaaccactcacacacagccactcacacataccacacaccactcacccctcacacacaccactcacacacatcactcacataccacccacacgactcaacactcacacaccactcacacaaccactcacataccacccacacgactcaacactcacacaccactcacacaaatataccacccacacaccactcaccactccacacataccactcacacaaaccactcaaaccaccaacacacacacaccagacacacacacacccctcacacacaccacttacacaccactctcacacaccatacacaccactcacacacgactcacaaccctcacacacaccacttacacacatgcaggcatgcactctcaaaccagatacactattcacaccactcacataccacacatactggctgtgccttctcggttgctgtctgagtgccttccctgtcagcaggtgacaagcatctgggggcacagtcagcctttgctcaccttagcatttatccctgaatgaacaaaggagcgagtgaacctgtcaatggtagacacctcccaataatattggaagagattgaagaagtccagctgttcaggcttctcgaagcatccgctttcctgctagccctggcatttcctcctaccagcaggacccttgcaaacaggggtagtggggggagccttccatcactcccgaggtctttctcgccaggcctgcgtgttgcagcttctgttatgagggctattttagaaaacagcctccggtagtcaccagtgtagaatatgctgctgcaggttgtttggaaggctgaggctattttcagctgcaggaccagcactgcaagcctcgagctgcctgagtgcagcagccccctctggagctccaggcctgtgtccccactgcagtggccctggattccggtcaggacaggacacgttgtcttgtgaccatgaggggcttccttacgctggcaggaaaggcccagggccgcctggattgggaaacccctgcctgctccctgggagtgtagaacgagtcccaggatgctgccctgtctgtagttagaggggcatggataggaaagaatgttttgagttcaagctttgaaatagagacttgaccataacatgactttcccccccatttcatgtgtttattttttaacagctttattgagagagaatttacatatcatgcattttaagtacatgattcaacaacttttagtatatttacagacttatgcaaccattaccacagtctagttttagaacattcccatcaccccacaaagatcccttttgcttgtttgcagttaattcccattcctactcccagcaaccactgatctgctttctgtctctagaaattctctgtctgtctcgggccattatttcgtagaaatgggctcatgaagttacaaagctttccaactaactggcagacaaggtgggttttggggggatccaactattaatggagggggattgtctgtgatgattccagattcctataaacatttcatgtaaggacgcaaagcatacttaaaggaacttcaggggacaaaatgtgtatcttttcccaactcggttgtggggtggggtccttgtgtgcaaggctgtggaggcccttcctgcgtgcactctttctgtaactcagtaacagaagtttgcagagtgccagccctgccccaggaacacctggacaccgagtctgtgcctgtcttcttgtgccatgcagccttcctctgggcagggaagagcacatgagtgtaaataactggagtggcctctatctggtttcctccccttggccctctgggaaatccacttccaacctgtcctagcctggaatagctcttttcagcggaaactcttccttcaagcaccatctcttcagcttaaacctatctatctgttcttgtttttgtttgtttgtttgtttgtttgtttgttttaactttttttcttacagacagattctaggtgtgttccccaggctggagtgcaggggctcgatcatagctcacttcactttagcctcaaactcctgggctcaagcaatgctcctgccttagccttctgagtagctgggactacaggcatgcatcacctcacccagctaattttttttattagagatgtctcactatgttgcccagtccggtctcaaactcctagtctcaagtgaccctcccacgtcaatgtcttagagtcactgggattacgggcatgagacactgtgcccagcttgttctgttcttcatctagaatttaaattagttaaaattctagctttaaccagaattctagattgtatttctcgataatcatgtgttcttcccatttttaacctaaagaaaatgcctacctcaccccgcaccaaacagacacacacacacacacacacacacacaccttttagattctatttctaacttcatcatcagggttatcaacttctctgagatattttgcattctttacttttattatttagagtctgaagatgctcatggtaaatgcagattatagagctaactttttgcacaaaaagcccacaaaacagtctttgagagagcatgtcagtgttacgtttggattttaaaagacagtgaagcttagctgagattctgttttacagattttgcgaataaataaaaagacagattccatttgctctggactgtgttagctgcagtgcggagggcggaaccggctgaaggaactgctgtgtattttcagcacatctcagtcagcttccgtttcagtcttctgtttccatcacccacacaggcatattcaagagttcctgctacatcgatgtacgctggtttccctttgatgtgcagcactgcaaactgaagtttgggtcctggtcttacggaggctggtccttggatctgcagatgcaggaggcagatatcagtggctatatccccaatggagaatgggacctagtgggtaagccatgggactaaccgcctggaagaaagctttcctattcctgggcaagctttaaaagtttgggattttccactgtcctttccggtgcgagcatttattgaattttgcagtagtctccataatttactgagagctacaggaggagaaacagaaaacagttaggatatgccatgctttccaagaggaactggcaactgcagtgaggatgcatttaaacaaaccagtgtgaggatagatctctctacgttatgcagatccactccatttctaaaagcaagttgaacagcaaatttcagttgatgggaacctatatttgattattttaaaataggaaaacagtgattacatttataacagtgtaaaattggtaatgtattatttataattattataatcatgtgtttccaatccaccaaaagaatatgtaccaatttggccaactatcactaaaatactcttaactctatagtaaatcaacaaggttttattcaagctaattacaaccccccccttttttttttttagcactttgcaaactttaggactgtgcttgtgtgtggtatacacattgaaataaacagggtaatttattgtattctaacaatggctccttctctcctcctccctatggaggaatccccggcaagaggagtgaaaggttctatgagtgctgcaaagagccctaccccgatgtcaccttcacagtgaccatgcgccgcaggacgctctactatggcctcaacctgctgatcccctgtgtgctcatctccgccctcgccctgctggtgttcctgcttcctgcagattccggggagaagatttccctgggtaagcgccccagtgtctggcgggagtctgagactggagaccttctgctgagatcagctctggagggctcacagcagacagcgcaggactccatcagggttcctggggattccctggctcatcccatggacctccgagcccacggtggctccaggacaccagaggtccctgattcgggctccgtgctggacggctgtgtaatcctgagaatactggaggaccctcagaggatgggggatgcacagggagggggccagctccattctgccttgagaggcctgtgctttcttccctcctgccaccccacctgttcctcaatggcgactggtcatcgagggaacaatttagcttagtatcagcttgcatttgtatgttacagtacccagtgtaattcttacgatcactcccatacgaagctaaggaaaccaagattttgaatggtggaatgagtttcccaatgtcttaaagagttgctaaacatcagatgtagcatatggtagaaatcattcccaaacccatatcttctgagtatgaggttcagaaaggttgaatgttgtatctaaggtcacatagctagttgagtagcaaacgtaagacctgaaatcaggtctcctgactgcatattttctttttcctgctacgtgaaactacttctcaataatattttacagagaatatgagagataattgtgccaagttaaatttttcagtttgtgttgatgcttttaaaattctgggtcctaaacttgtctccataagagactcctttgggactctggtaagtggcatggaatgtcccctggaaaatgcacacgcccatacatagggaaaacgtgcattccacgacattccccccagcgcctccctttcttttgagtgtcaggttaggagccctcgttagacagaattgaggccttcttgtctgtttttgtctgaggaaccgctgtgtgtttatgttttagggataacagtcttactctctcttaccgtcttcatgctgctcgtggctgagatcatgcccgcaacatccgattcggtaccattgataggtaaggcaagagttgggctcctctcttagagatatggggttagggttagagtgtgcccaggatttcccagcagatgaaactagaagaaatagggctgcactgcccccattttctctggaaggtgatgatttgctgtaactattcagagtcacccaggcccaagtaaggggaaggggatattcagctttgaggtttgacttttatctcacagaaatgccccccttcccctcataattctcctcctcatgcttgctttgaagccagatatttcatcgttagagatgcatcattttagcttaagatgttgttttcccacaaagcctttgttaaaatgggagaagcacacagttactgtgtcctgagataactcaatgtctctgtataaaagtttctagggaaatatgaatgagaaaaatatattttgcacaggtataaggcatgatcctctacccagggagggacaacaaaaacaagtctccactcccactgggcagggaaggttggaaggaggtatacagactgtcattacacctgctggcccctgctgtttgaggacctatgctgtgtctacctgggggtgggctagagggagagccctacctggatacccccaggctttaggaaccaagcagcaaaggcccttctttgtggaactccctgtatgtgcagtattttggccagagaaactgttggtatgaaaagcctttgtgggtatcatttttctcttggtaccatccagacagggaagaaccacctttccacctgattctgactccattctttctaccttccagcacactgctttcagtagagatttgcagcctcccttccgggggcagttgtcaggccttctctctctggactgatgacccgctgggaaaggcttggttggtgcatagcccacatctcgaaggatgggatgttgatggccccagggacatcagctttgctgccctctgttgatggaaattcagtctgggcaatcctttgacccccatctctccagaggtggttggtctgctcaggctgccgtgacaaaatactatggacttaggggcttaaataactaacagaaatttattttctcacagttgcactgctgaaagtccaagaccaaggggccattagggatggtttaacctgagacctctccccctggcttgcagacaaccactttcacaatgctttgtcctcccctggtagttcctctgtgcacctgcatccctggtgtctctctgtgtgtccaaattttctcttcttcattaaaagaacaccagtcagattggattagggcttaccctgatgacctaattgtacttaattacctccttaaagaccctatctccaagtacagtcacattctagggtactaggggttggggcttcaacatatgaattctagggggaagcataattcagctcataagggtcacggtttgctccagtctccttccttttctcaggggccctgatgctaactttaggtctcaaacttccagctctggcagagctcctcccaggtacctcttggtctttgtaggaaggcagtgagttccttcctggcgtgagggcctgtgagggctagctgaatgcttagcgccctgtaccctgatgctttccgcttagagttcagccccttgagtggacagccacaccaaaggtttaataattagagctgcccactaaagaatgccccctcctttctcctagacatcttggcctgtgtaattgctcatcattgcacaaatcctgcaaggaagaagttcctattttaatggaggctaccgtaacaaattgctgtagtctgggggcctaagcaacagacatttatttctcagagttctgcaaggctgcacgtcctcgataagggtggcagcagggctctggtgaggggccactccctggtttacagctggccctcttctcgctgtggcctcacgtggcaaaaagagagtgaattagctctttagcctctttttatgaaggactctaatcccattcatgagggctgcaccctcaggacctgttgaaggcccctgagaaaatcactcaccatttctctacttacacaacacttctgacaccaaagcggggcgtttctcccacatcgaccaattcttggaaaccagctgggcgtcctacagtgagttcacttcagtcctgacaccacctggagttagcacagcactcacagattaaggctcacaagaccatttctacttgagatgccagttagaagttccggcttcccatgcttctgaccaagtgtctataaatcggggagttcccaaaagcacatctttgagttcagccatttactagagtgactcactctagtaaactcagggaaacattttactgatatttattcattaattataaagcacagatgaatagtcagatgaaagaaatgcatagggcaaggtatttgggaaggggcatggaactgccatgccctctctgccctccaaacacctccccgtgttcagcactgggaaggtctccacagaactccatccttttgggtttttatggaggcttcactacataggcatgattgattacatcattggccactggcgatccactcaaccgtcagtacctctttcctccccaggggtcaagggttgggagaggggacagagcttgaaggttccaactctctaattacttggctggttcccctggcaaccaaaccccatcctgagggtatccaggaacctcagccataaatcatttcattagcatataaaaagacactgatgacttcagagattcaaaggttttaggagctgtgtgccaggaaatgggaggaagactaaatacatatttcttattataaatcacaatctcatacctcccaaagccccacctccagataccatcccagttaggactagggttttaacccatgaacttcgtggggacacaaacgtcatcctttgtaccacccccattggagagctgaggcccgaagaggctgagcatccactccaaactcacagccagtagctagtggaccaggatggaagcactcagatgctccatgctgcccctcacctgggcccaggtggaaggacacccatgacccattagaaccaaagctgagactgaagttctcgtcctgaaaagtccctgccactgaccccttcctcaggctggacagctggcagccaggtggtgtgcaggtttgccctcattgtgcccctggagcacagtagaggcctgcatcatgaacactggatggttcccatgccctcacatccagtatttacccacaggaacaagcttatcaccatcctgccaggcgatgctagctcttattgactgacaagtcggccagagtgcatggaagtgcaatgaagtgagggaaggtcactccgtgggcgggaagtcagaccacactggctggttttgcccacccagaatgtgggctgcaggcctggacacatgggcatcactgcaccctgaggccctgacggtcagagaacctgatcagggtgtgcctgtcctgtgacgtgcagtgccacaggatccccgggtctcaccctgcatctgttctctccacagcccagtacttcgccagcaccatgatcatcgtgggcctctcggtggtggtgacagtgatcgtgctgcagtaccaccaccacgaccccgacgggggcaagatgcccaagtgggtacgttcctcccacccccgatggagtcggagcccccctgtaaaggaggctcctcctagggtttatttttaaaatcacacaaaaaatgggcattcctaaagaaatagctttgggttttttgtttgtttttttgagacggagtctcactatgtcacccaggctggagtgcagtggtgtaatcttggctcactgcaacctccacctcctggattcaagcaattctcctgcctcagcctcctaagtagctgggactacaggtgcctgccaccacacctggccaatttttttttgtatttttagtagagatggggtttcactatgttggccaggctgatgtcgaactcctgacctcgtgatctgcccacctcagcctcccaaagtgctgggattacaggtgtgagccattgttcccagccagaaatagctttgtttctgtatttcgtcacctattgacgtgtctttgtgtagtgtgcagtcatggtgcacgtgttcccggatgccccgtggcactgctgtctaatctaactgcagagtagagtaaggctctcaaactggctgccctgtgtgttctatcaatcagcacggtgttttgagaagctagtttgttttttgatgcatgccgtgaagcactgtgctgcagttggaagcaacagatgagacagatgcgtagcaacatggttgaggcttcacaacagaatgaggagcaaagagtaagaaacggaatgagctgtgtacaaatatgtacgttcagtacatctagggatatcatccaaccagaagtctatgaaacaaagactaattgtcaccagtgcagaagggggaagggataaaaggaaacggatgaaaacagaaaggatggcatcccacagcctgtcagcttagcctgggccataccactcctgccccagctgctggcaccgtgcccggccacatctgcggatgctcacccacccagggatcctctcctgcacggtgtccagagctctgcatccacccttgcctggcagtcaggaaaccttgatgagggcctagggagggcctgagcttcttcccctcttcatgtgagctttgtaaagcttccccgtcctcctgtctagagagcctggcctaaggatttggggagctaaaaaggccctcacattccaaaagttgtctgtctttggagagcacttgtgtcccagttcagaagggaatctaggaatcaccaacaagctaaatgcagctgtagggggtgagatgctgtcaggcaccctccaggaataggggattgctgggcctcctgaaacagtcattgtggagttgttacctgaatgctcacttagcaaagactgcttcttaagaaatgctttacaaaattactgtttcttctcagagtttcacccacatggcccattccccttatacactatttagtaaagacttacctgtgagcccaccacagtggtgtgtggctgtagtcccagctacctgggaggctgaggtgggaggatcatgtgagcccaggagctccaggctccagtgagctatggtggtgtcattgccctccagcctgggtgacagagcaaaactccatctcctaaaaaaaaaaaaaaaaaaaaaaaaaaaaaaagactgacttgtagctcattacacaagcagtaatgtgagctcagcctacatggtgatgtctcacacacagaccacatcactacattccctgaggcttgttttgtgaaggcccccccttaaaacactggggtacatttgcacacattcacctgtatttttgtctgatttccttataacgctgacccacacttaagaaaatgcaaggccagaggtgagaggcctgagagctggaggcttgttggtttgctgctctttctgtctgtccatccatcagtttgaagcaggtaatacatttacctgtttctaaagtcaaaataaaattaaaattatacataaggaaatcctgctcccattccttcccctttaccctgcatctaccgtcaatactgataaccgttttaatgaattccttatttttccttctagtatttatttatgcaaatacaaaaatctaaacattctcatttcttgtaagtattttgactgatgagaagataagagaattaagacattgagacacaaaaccatttttaacgacctggagcactctactgctctagaacaatcttaattaagaacatatgctaattattcacctctcagcataaaagcttattaaaaccaattggctgcaaatgaaagatgaagcttatgcatttctctcgctttatatagcacactgcatttttctttcattccatgtgtatgtgaaacacaaacagcctccgagggacttttattatgatctgttgctatgaagaagatactgccgggtgcagtggcattatgtgacatttgcacagccagaaacaaaactgtagcctaacagaagaggtcaagagcacagtttgaggagtgccaagaggataattttatcttttaaatgctttggctttgaaagttaatgattcaggccatggaattcaaaatggacttggcagagtgtatcgtatgagcttgagatgtgcactgggggacgtgtagaccctgccatggagggagaagtgcctggtgctgctcgctccctgtgtgcactgctgccactggatgcaggcacactcactgccctgcagcctcccaggagagctggctcaggctttctggtgccttcccagaggggtggggttgtgcgagttttgaagagaatcttacagaccctttgacagatgagactgggaaaggctaaacatgtgaagtgacataaccacttacttactcattgtacatcgttgggccagtttattagcctctttgaacctcagtttgttggtctgtaaagtgaggggattatactcatttcaccggaccctgaaaggcccaagtgagatgacttgtctcatgagccttgtatggacggcccaactcacccaaggtttcacctggggccatatgtccctgctccttactgatcataaaaaaccctccaaggtcagcagacccaacctttccaggacacgcagagtgccgcctgcttgtaaagtacaatgggaaacaaagggttatttttatagctgcaatgaaactggtcttgtgcttccctgttcttgtccccagacctgtttgttgcagttatctttgataagatgttataaaaagatgaccaagaatgaaagctctgcagatacgaactgcacaatttactatctgtatatttatttcctaaagataggaaataaacctgttaggttactgatggaatttccccaaaatcataaaacaaaatgtaaatgaaatcaggatctggataatttcagggaaaaggcccacttttcatacactttacatggatgggcttgcaagaatgcttctttacctggattgaggcttcagttgtctctcttctttccatgagaggcaaaaccaggataaactccatggtgatttttctccagcttctttcatgcactctaggacacactttagaccagaagttagcaaattatggcctaggtggccaaatccagtccaccaagtgtttttgtaaataagttattttagaaaacatgcccatccatttgacgccttcaatgtgtgctacatcagcagaagtgagtagttgcctggccctttacagaaagtttgccaacttctgccttcaacttttcaaagtactctcccagacatcatcttattcggtcttcattgaagcctactgagttaggttagaggttccgaaactgccttggttcacagcacgttagtatctcaggaaatttttcacagagcccctggccaaaagaaataatacccaaggctctctttttaaatagatcaaaacactttaataagtatttatgccttaacaatgtagcacctatggggcacggcaccgcctctcaaatcttgggatcagattggagaccactaacctagtttctgtttcacatgaagttccttggtgtttgctttttatcagggtactttgaaaaacagctttgcaaagtggtcacgtcatcacaagagatgtggtaatctgatgttggaagcctgaagtgcttcaagcttcaagtttacctggtgtctcatggatatcctgggattgcatttgaaaatgtacaacctcccccaggcactctttgcgaatttgcagtggccttccagggcacctaacaggtagtgtgggagccagagttagatctgaaggtccccgggttacagatgaggaaggatcagagagggaaattgactttccctctttacacagctcagatagccttccccttccacgaagctgtcctccctgagattgcagtgtgcctgccccggagaacaatttagcttgttcccagggtgcatcagttttagtcttgcctcacgttgaactcgactgcttgtcatacgcaagcactgcttgcctgctaaaatcatctgggaggcagtggaggctgctacccccaggaccaatgaagcagggcttgtattgtaggatcttactgctgttgggatcagcccgtgtccgcctcagggctgctcttaacgttctgttgtctccccagaccagagtcatccttctgaactggtgcgcgtggttcctgcgaatgaagaggcccggggaggacaaggtgcgcccggcctgccagcacaagcagcggcgctgcagcctggccagtgtggagatgagcgccgtggcgccgccgcccgccagcaacgggaacctgctgtacatcggcttccgcggcctggacggcgtgcactgtgtcccgacccccgactctggggtagtgtgtggccgcatggcctgctcccccacgcacgatgagcacctcctgcacggcgggcaaccccccgagggggacccggacttggccaagatcctggaggaggtccgctacattgccaaccgcttccgctgccaggacgaaagcgaggcggtctgcagcgagtggaagttcgccgcctgtgtggtggaccgcctgtgcctcatggccttctcggtcttcaccatcatctgcaccatcggcatcctgatgtcggctcccaacttcgtggaggccgtgtccaaagactttgcgtaaccacgcctggttctgtacatgtggaaaactcacagatgggcaaggcctttggcttggcgagatttgggggtgctaatccaggacagcattacacgccacaactccagtgttcccttctggctgtcagtcgtgttgcttacggtttctttgttactttaggtagtagaatctcagcactttgtttcatattctcagatgggctgatagatatccttggcacatccgtaccatcggtcagcagggccactgagtagtcattttgcccattagcccactgcctggaaagcccttcggagagctccccatggctcctcaccaccgagacagttggttttgcatgtctgcatgaaggtctacctgaaaattcaacatttgctttttgcttgtgtacaaacccagattgaagctaaaataaaccagactcactaaatcctttccaataattgactggtggaaggaaaacaaaaaacaaaaactaaaaacctcttagcttttctgcaattcaactttttatttttatttttatttctatcaaagacggtagagagaaacagcttgatgctgtttctacattaaaaaaaaaaaaaaaa

SEQ ID NO: 53 - DNA, 4110 bp, Homo sapiens
aaaaggcacaggctgggcacagtgcctcacacctgtaatcccagcactttgggaggccgaggtgggtggatcgcctgaggtcaggagttggagaccagcctgaccaacatgatgaaactgtctctactaaaaatacaaaaaattagctgggcatggtggcaggcacctgtaatcccaagtacttgggaggctgaggcaggagaatcgcttgaacccaggaggtagaggttgcagtgagccgagattgcaccactgcactccagcctgggtgacagagtgggactgtgtcggaaaaaaaaaaaaaaagaaaagaaaaggaaagaaaagaaaagaaaaacgcacagaaattttaaccaaccaggaggcaaccagactctggggaactttcaagatccttatcacaatttcccaccccacccaccctgttacttcctctacttttctctctcttgttgtcttgtcttgaccctttgtgctgcaaaatgggtacccatacatggggctgggggctttagaccagtggatgggtctcagtccacacaaacagctaatctggatacacgaggccaaaaccttctcatttttctgggcaactttttttcctggcccaaaatgttttgattgttgttaactcacaggagtggggtagaccattaaggctaatttcaggcccaatattgtcatttttagaggagaaaagtggaaaccctgggcacttgcctgggtagtggctgaaccagaggtgacaccttgctcagtcccagcacagccccaccatgcacccggcaccacaccaggcactcaccctcttatacaacaggacaggtggcgtgtttgtgaaactagtggaggtttgtgttcaggaggtggaggagggaggacaggaaggagagggagaagagcatgcactggagaagtaaatccagggatcacacacagccacgtcctcacaatgcatgcttgagatcagtgtttgtactaagggcaatggggagctattgaagactccaggctggaagcaacacaggcaagagtgtgtcttagaagcatctctgttgcatttggtaggctgagatagaggctaagctgaggctgttggagaactcaacagcggagggtgttggcttgaactaaggaagtatgttgtgtaaacgggagtgctgtgacctgttgcagtcttactttcccactgacttctatggagtatcagtttcctgttgcctctgtaacacactgccacaaactggactttagaacaatagatgttcatcatcgctcttcccaggagtgtccggagggaaccagcccctgccaacacctggaccttaggacctctgacctccagaactgggagagactagatgtgtgtggttggaagcctctaagtcagtggtcatttgttatagcagtgctaggggcactaggaaacaattaccagaggcaagagacaaagtcttattagctaccctcctctgaaggacagaaaggaaaatatgagaccaggagggtgttgagagccaagtggattgaagtgaaggcttggggctccttgtggattttgtttgtgtgggttattttgttcccaggagtctcaggctgtgtagccaaatgcagtctgcagttctactctttcctttctttgaaagcaaacagcctcttttggaagagtgaagggcacccgaggttccagctggggctggcccaggccacggagctctcagaatgcgtacagcgcagacagcaccctgcagttgggtgggtgctggctttgaggtctggagatctagatgcccacaaggtgcccctggcaagtgggggctgcaaaggcatcacccaccccactgggctggggcagagaaatagacatgatgcatctgatgagctcggaaaacatttctaatgtatttattttttgtggttcggctacagaagagaataagaaagggctgaaggggatgaatgaacaagagcaggagaaggactgccctgagggcaggaggaaagggtgtgaatcgggatagaagtcagaaccccaccagcttcttgcctgggaaccaattgctggagctgcttccttccttcgttcattcctgctttcttcactccttcattccctgaacatcagacatggtcataggccctgctgagaattaaaacagaacaatgaacaagtcccactctcagaacgcaggcagaggtgaaatgttcggtgggctatggtgatggctttggagatttactggtagcttctgtggggttactctggctggggaccccaggggcctgctatggacagaattgtctccctctcaaatttgtatattgaagtcctaacacccagcgtgatggtatttggagggggggactttggagggtgattgagtttagatgaggccatgaagctgggaccccatgatgggattggtgtccttacaaggagaggaagaggctggagctccttctctcaccttgtgaggacactgtgggaagccacctgcaagtcaggaagggccctcatcagaagccaagtcagccataccttgatcttggaattccagcctccagaactatgagaaacaaattcctcttgttgaaaccatgcagcctcagctggtggaagcgttcggggtgagcatggctcctgcagggagatggagcagggacattgtgtcaggtctaaggctgctggtagagcctcagcttcctttccttggcactcaccaggccatgctgggaaagaagtctgagccaggtagttcggaaaacacccccttggtaactcttttgggaaacggagacagacatcaaggtcttatccactttgtgcaggaagatgacatgcggtaataaggaaaagaaaatgggaggtcctctgtctcatggaatttggggtcacaagtgtctgtacaacaccttactgggtctcaactcccagcttctcaggaacaagagacaaagaatataggtcagcagagcagagcccgaggggctggtccacagtccaagtcacacatgatgaggacagtattgagagtcatcacatgatgatggcagtgatggtggtagtgatgatggtggtgatggtgatgatggtggtgataaaggtgccaccggcgtcgccgccggcgtcactaccggcgccatcatcctcatcatcatcaccatcatcactatgaccatcatcaccattacctccatcatcaccaccatcaccacatcatcatcatcaccaccaccatcatcaccaccaccatcatcaccatcattaccatcattgtcatcaccaccaccaccaccatcaccaccaccaccatcaccaccaccaccaccatcaccaccaccatcactatcattaccatcatcatcatcaccaccatcatcaccaccatcattaccatcattgtcatcaccaccacggccatcatcgtcatccaggtcccgtcattactatcatcgtcatcaccaccgtcttctcctgcttcttctccatcattatcattgctgctgtcaccaccatgattatcatcatcatcatcatctccattgttctcatccttcttctcctccatgtgcctctatgtcttcccatacctttaacatgggttccatgactccttagcatggctgccatcatcatgtggatgtggatggtggtggtggtgatgatggtggtgatggtggtgatgataaggatgatgatattgattatgagagttgtcttagtccatctgggttgctttaacaaaatactataaattggaggccaagcatggtggctcacacctgtaatcccagcacttcggaaggctgaggctggaggatcactttaggccaggagttcgagattagcctgggcactacacaggaggatccatatctctacagaacattttaaaattagctgggtgtggtggtgtgcacctgcagtctcagttactcaggaggctgaagtaggaggattgcttgagcccaggaggttgaggctgcagtgagcaatgatctcaccactgtgctccagcctgggtggcagagcgagaccctgtctctaaaaaaaaccaaaaaaacccataaattaggtggcttataaacaacagaagttcctttctcata

SEQ ID NO: 54 - DNA, 146337 bp, Homo sapiens
gcgcaggagggcagcaccagaggccagtggcactcccagctcggtgagagggctgggaagccagggaataaaactgggagggtggggtggggctggtgtttggggcacctcaaactcacaacattgggaatctttgtgggtccgggaatggtaatcctgaggcctcagaacacaggtttcagattgataggcctgcaggtctccaggcagcaaccagctgagcgactaaagggcccaaggccagggctctagggatggggctcagcagaggctggggtaaggggagccagggaggagctgggcctaatgcagcaccgggtccccaggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatggcagagaaaaaaatcataataaaatggctttattttctggtacctcccagactctgatgactggtcccctagacacgcagtttgctgaaccaaccagccctagagcttcccctccaccgcgctgaggggactgacccatggcaggggatgtgggatgccccctgacttactacatcacaggaacagggccttcgtgggtagaaaccagccatgctgatgtgggccaggaggctgctctccgtttccgagctccttctcagagctgacacagctgaactatttaaggccctagcttagaacctcaataattcccaaatttaccaaaaatctgcctttcctagtcaaccaaaacatcacgttgcacgtgactctgctggcactgttgcttgtgaggaaatgaaccaaccatcacttacagggtaggcatcttttaaactgcaggtccaaagataaaaataacgagggaggctgggcatggggactcacgtctataatcccagcactgtgggaggctgaggcggcaggatcatttgagcccaggagtttgagacctgcctgagcaacacggcgagataccgtctctacgaaaaataaaataaaaaattagccaggcatggtggtgggcacctatagttccagctactcaggaggctgaggcaggaggatcccttgagcccaggaggtcgaggctgcaatgagccattgcaccactgcactgcagcctgggtgacagagcaagacactgtctctaaaaaatataaataggccgggtgtggcagctcacgcctgtaatcccagcactttaggaggccgaggtgggtgaatcacctgaggtcagaagttcgagaccagcctggccaacatggtgaaaccccatctctactaaaaatacaaaaattagctgggcatggtggcaggcgcctgtaatctcagctactcaggaggctgaggcaagagaattgcttgaatccgggaggcaaaggttgcagtgagccgagatcatgccattgtactccagcctgggggacaggagtgagacttcgtctcaaaaaaaaaaaaaaaaaaaatatatatatatatatatttttttttttttaaatgtataaatacatcatatatattttaatatataaatatattatatatattatatattttaatatataaatatattatatataatatattttaatatataaatattatatatattatattttaatatataaatattatatatattaattatatattttaatatataatatatattatattatataataataaattatatattatattatatagtaataagttatatattatactatataataatatagtataatatataatatatattataatatattatattatattatattatatattataatataaattatatatattttatatatatgttttatatattatatattttaatatatgaaacaggggaacttcttctaaggaaaagacagaattaaggcaacaggctgatcctagtttaccagagaagaaactgaggccgggagcaggagcccagctcactgaagggcagatcccaagtcagagtccaagtctccccacttttttatttatttaattttttctgagatggagtttcattcttgttgcccaaattgagtacaatggcacaatctcggctcaccgcaacctctgccttctgggttcaagccattctcgtgcctcagactcccaagtagctgggattacaggcatgtgccaccacgtccggctaacttttgtgttttcagtagaggtggggtctcaccatgttggccagactggtctcaaactcctggcctcaagtcatctgcctgcctcagcctcccaaagtgctgggattacaggcatgagccgctgtgcctggccttatgtctccccttttgaattcagagccttcccccgtgtagtgagtgcttctgcctctctagcccttcctgtgggttctgcctgggcctgacctctgtgagagacctggcaggaacaggtctgtcaggccttgtggggagtgggtgtgggaataggttttgatacccaacttagcaggtgatcctgagatgggaggacacagggctgtttgggatgggcgtcttagccatagtaaggtttggttcatatcaagcagggaccacccatggcgtcatttccaggccccacctcttcagtatgccatagaaaactacttgggcagtagaggtgtgggaagaaaacaaaaaagaaagctgggcataagtggcacacgcctgtaatcccagcacttttggaggccgaggcgggtggatcacctgaggtcgggagttcaagaccagcctgaacaacatggagaaaccctgtctctattaaaaatacaagattagccgggcgtggtagcacatacctgtaatcccagctacttgggaggctgagacaagagaatcgcttgaacccaggaggcggaggttgtggtgagccgagatcgtgccattgcactccagcctgggcaacaagagtgaaactctgtctcaaaaacagacaaacaaacaaacaataaaaaaaccccaaaaattagctgggcatggtggcgtgtgcctgtaatcccagctactagggaggctgaggcaggagaatcgcttgaacccgggagggggaagttgtagtgagccaagatcatgctactgcactccagcctgggcaacagagccaagactctgtctcaaaacaaacaaacaaacaaacaaaaaaacgcaggaaaagagtgtgtgatggctgaaacttgcaatttctcactctcaacgagccctggccccaactaggttatttgggctccctccctaggtctcagggacctctgttcaaagtcctagcaatctgggccaggtacaatggctcacgcctaaaattccagcactttaggagaccaaggcgggcagatcacttgaggccaggagtttgagactggcctggccaacatggtgaaaccctgtctctactaaaagtacaaaaattagccgggcatggtggtgcacccctgtaatcccagctactcaggaggctgaagcacaagaatcttttgaacctgggaggcagaggttgcaatgagctgagatggcgccacggcactccagcctgggcgacagagcaagaccctgtctcaaacaacaaaaaacaaataaaacaaacaaggtcctagcaaccctactaacctgttatgaagactgatacaggggcatcacctgccccaattttctgactcaggtcagccttatattcctactctaatctcacccctatccccgtcccacacccactattcttaaaacctccatggtcctccgggggcagctgtagacacattaagcccagggctatggggccactggaaccttctccagtgggtctgaaaacatcagcattccaggagttgatgagcccctacctgggcaccactccctcttgggcctgagaaggccggggggaacctgcaaggaatatgtggaattctatatggtgcctctgatactgcggtaatgtcagggagaggtttgttcaactggtcagggccctgaaaccccgatcactttctcatctctgcatcttgaaggctagcagagaggaggaaccctgagctctctaggaggtgggtaggtggtggcagtacagactcctagatgtctaaacggagttgcagagagaaggctttctcggtagaccctggaagggacttttacggtagaactttcattttacaagcagggatagaggcctagatggggacagagacgtgtccaaggtaaaacaatggacggaggcagggcagggagaggccaggtcctagactcggcctcagcacccctcccacacacacatcgacacagaagctggtccagatttataatttaatggctgtgcagatcccagtccctcatttctgtcgctcacgtgcccactggtctggggtcagggttttctgttcaaaggcatggatgtgcgggagctcttctgctaggcacgcgttcaccagcctggggcgagagatggggttaggaaaaggccagcggtgatcgcacaccccgaggctagggtgacccaagagactggtgtccccaaggttgtagtccccaggccgtgggaacacgtacttggagagagggtctacatcgaaatactcgaagcaggggtcacgaaggcgggatcctcaaggtccctgagccacgccagggggagtgcgggagtcaggttgcaggggtagggggagtggctggggttgtggtacaggagctaggcaaggtgctcccagggccttacctgtgtctctgaagcagcggtttcccctcgaacttggccgacaccaccaggactcggaagctacaggagcaacggttgagggtcgtgtcctccacctcctaccgagcggaagaatatgaatggtgccgaacccgccccccgagctcttttccccttgtccggcggctcaactcaccacatgctccgcctccaggtcccgctgcagcttctcgcggaggtattcggcgctgagttccatggcggcagtccagctggaacggcagcccagcagggacacaaccccagctcgggcgccggccacgctaccttgctgccttacaggagccacttccgctggaaaactcacttccgcccttactaaggcgtacgtcaacgcagtacttccgccctcaagcagccgggctttccagcggtccaggcttttcgcgcttgccatgtgtcagccaatcagagcctgaggaaggtgggactcgggcggagccgatgctgaatggtacgcgctcgccgactggacagcagtctggcttccgcggtcggacttctacacccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctggtgagagggggaggccttctgtgccgggaggaaggcgtcccagaggaggcggaccccgcggggcacaggcctgttgagaaggaccggccaggactgtgacagaggcggggcgtctgtggtggggacggggcctgtcgcaggggaggagcgtgacggggaggcggtgcccggggcatctccgcggcggaactcagggaaggagctagctggggcgggggtgatgatccaggctgggttccagcatagggctcttggtgggcacgctggggtcgggtggaatgcaggagagagaggaggtgggacaggtgggtacctgggctggaggcagggcctgaggtgggcaggtgcagagggctgcacttctcggctgaagccgggaatgaggaccccgctctcgggtgggattggaggggacccgcggctgaggcgctgggctgcgacagggacatcacggttctcctcctcagggagatggtgctcgtcgtgcacggcttcccgtcctccgtggccgcccttcgggtaaggaaggagaccgggcagcggcggccgggtgagggcttgggttccgcccctcgctccgagccgccctgatgcccctgtacgccgcccgcagtttgagtgggcttggcagcacccgcacgcctcgcgccgcctggcgcacgtggggcctcgcctgcgaggagagacagccttcgctttccacctgcgcgtgctggcgcacatgctgcgcgcaccgccctgggctcgcctcccgctcacgctgcgctgggtgcgcccagacctccgccaggacctctgcctcccgccgccgccgcacgtgcctctggccttcgggcctccaccgccccaggccccggccccaaggcgccgcgcaggtccctttgatgacgcggagcctgagccagaccagggggatccaggggcctgctgctccctgtgcgcccagaccatccaggtgaggtccccccgaggaatggatggctctagagtccagacgacttcggatccagctctttcttgagggaaacccactgacacgctttggccaccctatccccatctctaagatgctgatgctataggacttacggccattcctgagcaaagcaggccctgctcagggccttcaccatttccccttcaaagaaaaggttcttccctaggccatcagtactccgctgcactccagtgtggtcgacagagcatgaccctcttttttttttttttttttttgagatggagtctagctctgtcgcccaggctagagtgcagtggcgcgatctctgctcactgcaagctccgcctcctgggttcacgccattctcctgcctcagcctcccgagtagctgggactacaggcgcccgccaccacgcctggttaattttttgtatttttagtagagacggggtttcaccgtgttagccaggatggtctcgatgtcctagcctcgtgatccgcccgcctcagcctcccaaagtgctgggattacaggcatgagccaccgcgcccggccctttttttttttttagacagagtcttgctctgttgcggaggctggagtgcagtgatctcagctcactggaagctccgcctcctgggttcaagcgattctcctatctcaacctcccaagtgtgccaccacacctgccgaatgtttgtgtttttagtagggatggggttcgccatgttgggcaggctggtctcaaactcctgacctcaagtgatctgcccgcctcggcctcccagagtgctgggattataggcgtgagccaccatgcctggacatgaccctgtctctaaaacaatgtaatgaactgcagctcattcttgtgtgcacttttctgcaccccctttcccttaacacttactattgtctggcatgctacgtgttttcttgatctcattagcctctcccaccccaactgccacactgcactatcagagggcagcacttatcactgctgtagaacaaagtcctgcactgagccgatggcccagaaattttctttttatttatttatttattttttttttgagacagagtcttactctgtcgctcaggctggagtgtagtggcgcgatctcagctcactgcaacctctgcctcctggtttcaagcaattctccttcctcagcctccagagtagctgggattacacgcgcctgccaccgcgcctggctaatttttgtatttttagtagagatggggtttcaaccatgttggccaggctggtctcaaactcctgacctcaggtgatcctgcccacctaagcctcccaaaatgctggtattacaggcatgagccaccgtgcccggcctaaatatttaataaaataatggacgatgggtgccttctactgagctcccggtaattgtgagtgagtagaggacttgccctggggacattcagtgacctgctgggtgttgctgagctgtgaggaagttcaggtctggctgcagtggtgaggctgtgactcaatcaatcactgctgatgctcccaggacctgcaccagcttagtcctaggggcaaggattttaactgtccacctcagtttcttcatttgtaagatgcaaataacagtcacccctgcctcatgggatggagctgtgtaatgcccgcaacagtgcctgctgcatagaggggttgctgccagctgcctctccctccttgtctcttacctgcctgctgcctgggtcaggatgaagaggggcccttgtgttgcccccaccctggctgcctgctaagggcccatgtgatctgcctggcagaggagtttcttcaggaagaaccagggcagcttctgcccctagagggccaatgcccttggtgagtgcagtcccctggccccagcctggtccacctctgggaagagggtgcccagttgtgcaatccaggcccaggcagctgagccctcatctcagcatccagggcggatactggagggggcttgtggcatctgactctgtatctcctacctgcccctctccttggtagctgtgagaagtcactgctttggggagacctgatctggctgtgccagatggacactgagaaagaagtagaagactcagaattagaagaggtgagtgggctttggtggcgggctccctaccccactccctgccctgggctgcctgtgaccacactgcttgcctctgcaggcacactggacagacctgctggagacctgatcctcagtgtccttaccccctcctacctcttttctgtgccacctgctgtgggtccagcaggtttttacttgagtacaataaaaagtctgagtcaagggtgccttatggtggatgctgaggggaggggcggagctagtagcccaaggtcctgccagtcacggggcttcctcaggggcacagaggaggcaggaggggcccctggccctagcacgtgaacagcttctactctgcctggaaaccccatgcctcagctttcccctacttgcctctgagctcatgcaattcttggaagcctgggagacttaccttgaaattgaatgcaaataggacaaagaccaaggaggatggggggatgccctccttccacggggccctgtggcttccaagtcttaatctcctctagtctcttgtctacggagcctccttcaaacccagggaaagaaaagcacctgccagggttgtttttcttctaggatcttctattgatgctctgtgaggtcccccaggagccatgaagctagggctggctcctagggcaatgggactacagtgtccttgtcctttcttattctttctgttctttctttctttctttttttttttttttttttttttttgagacagagtctcactctgttgcccaggctggagtgcagtggtgtgatcttggctcactgaaacctccgcctcctgggttcaagtgattctcttgcctcagcctcctgagtagctaggattacaggtgcccgccatcatgcccagctaatttttgtatttttagtagagacagggtttcaccatgttggccagcttggtctcgaactcctgacctcaggtgatcctgctgcatcgacctcccaaagtactgggattacaggcgtgagccaccacgctcagcctctttcttgttctatatgtccatgctctgctccacttctgccccttcactctgcccccacacatcactccagactggccttgtggtcagagcctggaatgcctgggctgctgggggcctgtggactgcactgggccagaacccctgccgccttcaagactggcctgtagccagcaggtaggtgacttttcccaggccggcctatcccacctttcccctccactcactcacctcccttgcctgggtcaattagagaaagcttgtcggccaggcatggtggctcatgcctgtaatctcagcactttgggaggccgaggcgggcggatcatctgagctcaggagtttgagaccagcctggccaacatggcaaaaccccgtctctactaaaaatacaaaaattaaccggatgtggtggtgtgcacctgtaatcccagctactcgggaggctgaggcagaagaatcgcttgaacccaggagggggaggttacagtgagcggagatcgtgctactgcattgcagcctgggcgagagagcgagtctccatctcatataaaaaaaagaaaaagaaagaaagaaagcttgtctgttggcctgccctgcagggtggagttcagagggaaggtcaggagcctagtgacagctcaaaaaaaaaaaaacccaaataccaatgttggccccttttgcctttcattcatgtgttttctatacactaaactcacatattgggtttgcagatcactccaagcttggctggagctgtggtggtaaggagggtaatagagaagcttccccaccctcaaccccaccccttccttcctggagttcccagccctgactttagatccctcccacactggaccttcaaaaccctcagggcagagagcagccctacactccctacaccacacccatactcagcccctgcaggcaaggagagaacaggtcaggttcccgagagctcaggtgagtgacacgttggaatggcccagggcaccttcaccctgctcagcttgtggctccaacattctagaagccgaggcctctgccatccctgccctttcccatggatattccatttcaattagacaacccagcctggccggaatccccctgcgttccttcttttcctttgtgtatttttgagacagggtgttgctccgtcacccaggctggagtgtagtgggatcctggcccactgcagcctcaaattcctaggctgaggcaatcctgccgcctcagcctcctgagtagctggggttacaagagcaagccaccacacccagctaattttgaaaaatattttttgtagaggagaggtcttgctttgttgtccaggttggtctcaaactccagggctcaagggatcctttcccgttggcctcccaaggctctgggattacaggcgggagtcaccctgcctgggcccctccttttgatgagtcatcagttttcattcccgcacgaggctctagcccctggtaccagcttagttgctcaatgggctgtgtttgttctggagcccagatggactgtggccaggcaagtggatcacagacctggccggcctgggaggtttccacatgtgaggggcatgaggggggctcaaggaggggagcatcggggagaggagcgcactgggtggaggctgggggtcccagcaggaaatggtgagacaaagggcgctggctggcagggagacagcacaggcaggccctagagcttcctcagcacagctggactctcctggagaccttcacacaccctgatatctgggccccgcgctacgagggtgctttcactggtctgcactatgccccaggccctgggattttgaacagctctgcaggtgactgaaaggtgcggccaggctggggaacgacctggtttcagccccagccccgccactgactgactttgtgagtgcgggcaagtcactcagcctccctaggcctcagtgacttccctgaaagcaaaaactctgcaaaggggcagctgggtgctggctcacacctgtaatcccagcactttgggaggctgaggtagacaaatcacttgaggccaggagttctagaccagcctggccaacatggtgaaaccccatctctactaaagaaaaaaaaaaattagctgagcatggttgtacatgcttgtaatcccagctacttgggatgccgaggcgggaggattgcttgaacccaagaggtggagtttgcagtgagctgagattgtgccacactgcactccagcttgggtgagagtgagactccatctcaaaaaaaaaaaaaaaaagagagaatcccactttcttgctgttgtgatggtggtaagggaacgggcctggctctggcccctgatgcaggaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggtaagtgaggagggccacccaccctctcccaggcggcagtccccaccttggtcagcaaggtcgtgccctcagcctgctcacctcctatctccctccctctccaggcaccacctgggtgagccagatactggacatgatctaccagggcggcgacctagagaagtgtaaccgggctcccatctacgtacgggtgcccttccttgaggtcaatgatccaggggaaccctcaggtgcatggctgggtcctgggggtaagggaagtggaggaagacagggctggggcttcagctcaccagaccttccctgacccactactcagggctggagactctgaaagacacaccgcccccacggctcatcaagtcacacctgcccctggctctgctccctcagactctgttggatcagaaggtcaaggtgaggccgggctcaatggttcacacctgtcatcccagtttgagactgaggagggaggatcccttgaaggcgagagatggagaccagcctgggcaacattgctgtagagatgacatcccatctctacaaaaataaaattaacaacctggtatggtggcatagactgttcccagttacttaggaggctcagcggggaggactgtttatgcaaataggaagctgcaatgagccctgatgatcctgctgctgcactccagcctgggcaacacagcaaaaccatctctacgaaaaaaaagttcccactgactggcaaggaaagccaggaaggggggctcaggtgccctctcagccatgtacctgttcttctggaagggcctcctcgcttctgccaggctcatcacatcttttttttttttgagacagagtcttgctctgtcaccctggctggagtgcagtggcatgatctcagctcactgcaacctccgcctccccagttcaagtgattctcctgcctcagcctcctgagtagctgggattacaggcgtgtgctaccacacccggctaatttttgtattctttttagtagagacggggtttcaccatgttggtcaagtggatctcaaactcttgaccttgtgatcctcctgcctcgacctcacaaagtgctggaattacaggcgtgagccaccgcgcctggccctttttttttttgagacagtttcactcttgttgccgaggctagagcgcaatcgtgtgatctcggttcactgcaaccaccgcctcctgggttcaagcaattctcctgcttcagcctcccaaggagctgggattacaggtacctgccaccacgcccggctaattttgtatttttagtagagatggggtttcaccatgttggtcaggctggtcttgaactcctgacctcaggtgatctggccaccttggcctcccaaagtgccgggattagaggcatgagccaccacgcccagccttcatcacatcttgagagaggacactgtctgcctcttgctctgatgagggtctgatgcaaggatagtgagtctctacagtgcacacttaagaaaggcagcatgtgggtgctcacaggtcagcggaggagggggagctggtggggaccaggcatgccttgctccagatcaggatatgatggcattggtgcagattatattagtatagaatatggtctcaggaaccaggcaggactttggcttccgagcagggttcagatcccagcttggccctacctgtgcagtgagatctcaagcaagtcagcctctaagcctcaggttcctcctttgccagttcaacagatgagctggcctggggtgggctgtgtggtgatggtgctggggctgggtcctctgcccctgcaggtggtctatgttgcccgaaacccaaaggacgtggcggtctcctactaccatttccaccgtatggaaaaggcgcaccctgagcctgggacctgggacagcttcctggaaaagttcatggctggagaaggtgggcttgactggaggaaggagggtgtgaagccgaggggtggtggctataacgtacagcaaccctgtgtcggtgccccctgcccgcttctctagtgtcctacgggtcctggtaccagcacgtgcaggagtggtgggagctgagccgcacccaccctgttctctacctcttctatgaagacatgaaggaggtgagaccgactgtgatgcttccccccatgtgacacctgggggcaggcacctcacagggacccaccaaggccacccagccccgtccctgggcggctcccacagcaagcccggattccccatcctacctccctggcccaggcccccccactgcagccccacctggcagcaggctcggcacagctttcatcttctgcacctgagtcagctgcatgggtggccacggatcagatacttagtcctattgcttatcctcaccaaagggtgtgccacccagggccacagtcatggaagaagaccatcccggtcctcacccataggcgccaagccctgttcatgatgggatcacagggcagagatcaattcattttactccagagactagggccccaggggttgaggctctttggggtttctaggggaagtggccagatcccctctgaggttagagagggggacccgttttgttttgctccactgaggagccctctgctgctcagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggtgggtgctggccagcacgggggtttggggcgggtgggagcagcagctgcagcctccccataggcacttggggcctcccctgggatgagactccagctttgctccctgccttcctcccccaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggcacagtggctcatgtctgcaatcccagcgatttgggaggttgagctggtaggatcacaataggccacgaatttgagaccagcctggtaaaatagtgagacctcatctctacaaagatgtaaaaaaattagccacatgtgctggcacttacctgtagtcccagctacttgggaagcagaggctggaggatcatttcagcccaggaggttgtggatacagtgagttatgacatgcccattcactacagcctggatgacaagcaagaccctccctccaaagaaaataaagctcaaaataaaatatgatttgtgttcatgtagagcctgtattggaaaggaagagaaactctgagctgaaagagtgaatgcccggtggggccacatatggtcacctctcccccagccttcagctccccaggtcaccatatctggggaggggagaagggtttggagaagtaaaacccaggagatgtgtggaggggggatgtctgtttaatcccagcacatcctctgctgtcctgccccaagatggtggaggacgtcgagtccgccgggcagcgtcactttttcttgggctccttagaagctaccaggtacctctgggccacactgagatgaggggagtagccgtctgcataggaggtgtcttcaaacaggatagaatagtcctcctggggctgtggggcaggtggacaggaagggcagagagcagccccggggctggtgtcactcacttgttggtggcatggctgtaactgaccacctcggccaggatccactgctcatccccatccacggccttcacccgggcagccaccttgtctccaggtctggccacgtagtctcctgaggcagggatggccccacagaggggtgggggcctgtgagtggaacaaaggatcagtcccagcccctgggcaccagccccttcctcgcagctgctgccctcacttgtcaccaggcttcccaatccacaggggcagggtcatggccgactgctgcagcagggtcatcagcacccctctgcgcatggtcttccggggtggctccaagtcattgtagagacccgcgatcttggccactgtgggaagaaagggaggcctgaggccccagggacaggggctggccctgaccccccagcatgctgaactgagctgctggaggagcacctgggagcccccagctcccgagtgagcccgagggcacagcaggactgtgacctgatctgccaggtgtcctacaggggctgctgcgctcaactacatatgggtgagacggcagcacaccaggcacccaggggaaggaaccagggagggacaaagcgggttctgaggtgctggtgaggttctcttcttgatgtcggtgctgacacagaagtgtgtttcgttagtgaaaagttcctaaaattcgaagggtcccgcgggaatcggggcgaggccgggtgcctcttcagcgtccagctgctctactgcctgaatccctggtacccgggccctgtctacgtggggctcactgtcaaccctgttcgtccagcagcacaatggtggccgcaaaaaaggcggggcttggcggaccattggccgaggtccctgttaagagggggagggtctctgtgcccggaggaaggctccctggaggaggcggaaccggggggcacaagcctgctgagagggacccactaggtctgtgacgtgcgcgggacgtcccgggcgaggcctgttggtggggggaggctgtcgcaggggaggagcctaacggggaggcggtgccctgggaatctcggcgttagaactccggagagcagctggctgaggcgagggtgatgatccaggctggggtccagcgcaggggtcttggggggcacgctggggtcgggtggagcgcaggagggagaggaatgagaacaggtgggtacctgggctggaggcgggacctgaggtgggcaggtgcagggggcgtgccttcaggcagttgcggggccagggctcggctgaagctgggagtgaggaccccgttctccggtgggataggaggggacccgcgatgctgggctgcgctggcggtagggcgcggcggggctcacaggaacattcctgttgtcctccccatggagattgtgctcgtcgtgcacggcttcccatccgccgcggccgcccttcgggtaaagaagaagaccgggcggcggcctgtggcctggatttggggtccgacccccgcccggagccgccttgactccaaccccgccgcggttggagggggcctggcacccccgccctgggcgctcctcccggtcccgttgcgccccgacctccgtcagccgcacggcactggccactgaccgtcgggcctcctccgccccagggcgccgcgcaggtccctttgctgacgccgagcctgagcctgagccggtcccggggtccaagagggctgtgtgcaccctgcgcgtccgcgcgctccaggggaggtgcgctccaggggaggtccgccccaagcagagcggcacatcctccagacgacttcggatcctgctgttgaggagccaggaaacgccctgacactgttgcggccctgtccacatctctaagatggggatggatgatagtacttctggccattcctgagcacagcaggacctgccttttccctttgactggaaggttcttctctacatcttcagtcttgataacctgccacctccacagggaggtcttccctggctcccaatttaaaattgcagctctgagaagccgggcatggtggcatatgcctgtagtcccagctacgggggaggctgaggtgggaggatcgcttgagcccaggagttggaggctgaagtgagctatgatcactccattgcactccagcctgggggaaacagcaagaccctgtctctaaaaaaataaaatacaataaaattgcggctctttcttgtgcacttccctgcccgcccccctttcctgaacccttattattttctgccatactacaaattttatgcatctcattaaaccccttccgaacctgtgtactaaactgcctgggggcagctctcatcactgctgtagaacaaagtcccacatagagccaatggccaagaaacagttaataaaataacagacgatggtcctggcctctactgtgagtgagtaaagggcttgccctgcagagattcagtgatctggcgggggttgctgagctatgaggaagttcagatctggctgcaggggtgaggctgtgactcagtcaatcactgcccatgctcacaggacactggccagcttagtccctgggggcaaggattttacccccccccccccacctccatttcctcatctctaagatgtgaataatcgtcgcccctgcctcacaggattgagctgtgtaacccccctcccaccttttttctatgccatccactgcgggtctggggctttttactggaatgcaatacaaagtctgagtcaagggtgccttctgttggttgctgagggcggaggcagagctagttgcctgtggtcctgccagtcaaggggcttccagaggagggaggaggggcctgtggccctagcatgtgagcagcttctcctctgcctggaagccggacgcctcagcttctcccacactcccacctgcccgcttgcctctgaattcacacaattcttggaaggcttgggagactcacctttactcaaatggttacctgtctcgtgtctcgtgcccagcttgaccttttttttttttttttttttttttttgagttggagtcttgctgcgtcacccaggctagagtgcagtggcgtgatctcagctcactgcaatctccgcctcccgggttcaagcaattctcctgcctcagcctccccagtagctgggattacaggtgcccaccaccgtgcctggctaattttcgtatttttagtagagacagggtttcaccatgttggccaagctggtcttgaactcctgacctcgtgatctgcccaccttggcctcccaaagtgctgggattacaggcgtgagccaccatgcctggccccagcttgaccttgaactttaaatagtgaagacaaagaatgaggagggtggggggatgccctccttccacagggccctgtggcttccaagcctcaacctcctctggtctcttgtctgtggagcctccttcaaacccagggaaacaaaagcacctgccacgggctgctgtttttctaggatcttctagcgaagctctgtaacttcccctgagagccatgaaactgggctggctcccagggtgatgggactccagcgtctttgttctttcttgttctatgcatccatgctctgctccaccgctgccccttcaactctgcccacacatattactccagactggccctgtggtcagagcctggaatgcctgggctgctgggggcttgcatgcaggctgcactggactagaagcattggcgccttcaagactgccctgggaaacatgacctgccctgtttctgtctagtgagtacccatttttccccactcaccggctcacttcccttggctgggtcaattagaaaaagctcttctgttggcctgccctgcagggtggagttcagagggcagctcaagagcccggtgacagctcaaaaaataaaaaaagccgccaggagcagtggctaatgcctgtaatcccagcactttgggaggccgaggcaggcggatcacctgaggtcaggtgttcaagaccagcctgaccaacatggtgaaaccccgcctctactaaaaatacaaaaattagccgggtgtggtggcggatgcctgtaatcccagctactcaagaggctgaggcaggagaattgcttgaacccaggaggtggaggttacagtgagccgagatcctgccactgtactccagcctgggcgacagatcacgactccatctcaaaataaataaataaataaattatacattgggctcttttgccttttattcttgtgctttctaatcacaactaaacactaaactcacatcttggctttgcagatcactctaagcttggctgcagctgtggtgctgaggaggctaatagagaagctccctcgctctcaaccccaccccttccttccgggagcaaacccaagtctggtcccgactccggatccctcccacattagacctaccacaccctcagggcagacaacagctccacacaccccacactcagccaccagggcaagggagcaaaattccagaaagctcaggtgagtaccagagtggaatggcccagggcgccctcaccctgctcagcttttggagccaacattccagcagccaaggcctctgccatactggctgtttccccacggatatccagtttcactaggggaactccagcctggcttcccttctttcttttttatttttgtttttttgagacaaggcttggctctgacacccaggctggagtgcagtggccaaattgtagctcactgcagcctcaaaatcatgggctcacatgataatcacgcctcagcttccctggtagctgggtgtacaggagagagccaccatgcccagctaattttttaaacttatttttaatttattttttatttttttgagacggagttttgctcgtgttgcccaggctggagtgcaatggcatgatacagctcactgcaacctccgcctcctgggttcaagcgactctcctgccttagtctcccaaggagctgggattagaggcatgcgctatcacaccctgctaattttgtatttttcatagagaaggggtttctccatgttggtcaggctggtcttgaactcccgacctcaggtgatccgccccaccttggcctcccaaaatgctgcgattacaggtgtgagccaccacacctggctgcccagctcagttttaaatattttttttctagagatggggtcttgctgtattgcccaggttggtctcaaagtccaaggctcaagtgattcttccccactgggcctccaaagctctgggattacaggcatgagccatggtgtcccctcctcattctgcggaatcatcagagttttgttcattcccacaccaggctctggcccccagtaccagctcagttgctcaatggaccatgcttgtcctggagcccagatggactgtggctgggcaggtggatcacaggcctggccggcctgggaggtttccacatgtgaggggcctgaggggctcaaggaggggagcatcggggagaggagcccactgggtggaggctgggggtcacagcagaaaatggtgagacaaagggtgctggctggcagggagacagcacaggcaggccctagagcttcctctgtgggcggcaagccacccaggcaccgaggcaagagacagaggacacgatctgttccagtataataaaatataaaacaagaatagttataccagatatagatcttagatatgattatatatgaatatcattaatcattagtttgtagcaattactttttcttccaatattataataatccttgctctataatcatagcctaggaaaaaccaggccatacagagacaggagctgaagggacatagtgaggtgtgactgcaagacaggagtgcgagccttctgttatgcccggacagggccaccagagggctccttggtctagcggtgacgccagcgtctgggaagacgcccgttaccaggcggatcgtggtccagcggtagcaaaaggtgtcaagaaacaacacccgctactcagcagaccaggaaaggggggtctccctttccctgggggagtttagagaagactctgctcctccacctcttgtggagggcctgacattagtcaggctcgcccgcagttatccggaggcctaaccgtctccctgtgatgctgtgcttcagtggtcacactcctagtccaccttcatgttccatcctgtacacctggctctgccttctagatagcagtggtaaattagtgaaaatactaatagtccctgatatgcagaaataatggcataagctgtctttctctttgtctcctctccctctctgcctcggctgccaggcagggaagggccccctgtccggtggacacatgacccacgtgaccttacctatcattggaggtgactcacattctttaccctgccccttctgccttgtatccaataaataacagcgcagcccgacattcggggccactaccagtctctgcacattggtggtagtggtcccccgggcccagttgccttttctcttgtctctttgtcttgtgtctttatttctacactctctcattgccgcacttagggagagacccaccgaccctgtggggctggtccctacagagaatgacttgaacctgggaggcagagattgtagtgaggtgagattgcaccactgcactccagcttgggtgacagagcaagactctgtctcaaaaaaaagatgaggtgagttcagtttgggaaatgttgaatgccagatgcctttggcctattcagagggagattgccgaagcacagaggagagttcatgacagggtttaattatttttagtgctctcatgtcccagattcggccaattggagtccctccacgctggttcctgtgtcctgtgacatcacccatcttctttctccttttcttctttcataagccacttccttcctggcatgacagtgtgttccaggaccatcttgtaccttgcacctgccctgccctggccctagaatcagccaattctctgaggcatcctgattcctttttgtgggggaacggtttgagaacaaaatatactactacatgatactatattctgacaggaaaaaacacagccataagaaataaagccatggccgggcacagtggctcctgtaatcctaacactttgggaggctgaggcaggaggattgcttggggccaggagttcaagaccaacctggcccacatagtgagccctcatctctattaagaaaaaaaaaaaagaaagaaggaaagccatatttggatgagtttagtcttctgattatttttgctgaagttttaaattattattattattattttttgagacagagtctcgttctgttgcccgggttggggtgcaatggtgcagtctcagctcactgcaacctctgcctcccaggttcaagcaattctcctgcctcagcctcttgagtagctgggattacagattcctgccatcacgccctgctaatttttgtatttttgttagagatggggtttctcaatgttggtcaggctggtctcaaactcccgacttcaggtgatccggctgccttggcctcccaaagtgctgggattacaggggtatattttatatttaaagtatatttaaaaattaagggccaggctcagtgtctcacgcctgtaatcccagcactttgggaggccgaggtggctggatcccatgaactcgggaatttgaaaggcacaagagcgaaactccgtctcaaaaatatatgtaaaatatattttatggccaggcatggtggctcacaaccgtaatcccagcaccttgggaggccgaggtgggcagatcacctgaggtcaggagttcaagaccagcctggccaatatcgtgaaacgctgtctctactaaaaatacaaaaaattaactgggcgtggtcgtgtgcacctgtaatcccagctgctcagaggctgaggcaggacaatcccttgaacccgggaagtggaggttgcagtgagccgagatcgcaccattgcactccagcctgggcaacaagagcgaaactccacctcaaaaacaaaacaaaataaaacaaaacaaaacaaaacaaaatatatgtatatacacacacacattatatgtaatatctacttttaaatataaacataaatattataaagcttttattgcaattgttcattttagaaacttcagaaaatacaaattagtaaaaagaagaaaataagtctgtaataccacttttaagaactattttaaaaacctctagcttttttttgagatataatttacataccaagacttttttaaaaaaaaaaattcataatggtgacttttttatcggactgtatagaataaagcttgttaaaatgtctaagatattttgtaatatatgaaaatttcagctaaacttgtgctatagcatcccatggtttgaatatattattgaaaatcattccataaacaatggtttggtatatagttttaacaattcaaggctgggcacaatggctcacgcctgtaatcccaccactttgggaggaggaggcaggcaaatcacctgaggtcaggacttcaagaccagcctggccaacatggtgaaaccctgtctctaataaaaatacaaaaattagccgagcatggtggcaggtgcctgtgatcccagctactgaggaggctgaggcaggagaatcacttgaacctaggaggcagaggttgcagtgagccgagatcttgccactgcactccagcttaggcgacagaatgagactccatctcaaacaaaataaataaataaaataattcagcaggatgaggtggctcatgcctataaccccagcactttgggaggctgcggtgggactattgcttttgcctgggagttcaagaccagcctgggcaacatagagataccatgtctcagaaaatatatatataattaattttaaaaaagagaattcattgatgattctgtatttacaaatatattcctgcatcatttgttcatggtaaccaggaaattgcaatgcataaatacatgctgtcatttccaaagcggctctcttccagaattggtactgattctagtagacttttcattctgatgttaaaaatataattaatagaaatgtcttgtacctaatagcttttttccccacaactccccaaccccctcactctagaggccttagtagtctaatttaatcagcttagtctgaaatataatactaccttggcatcttgttggcctagtatttcttactcttttatggaatgaactgtgcaattgttttgtgtggctaaaaggtattctaggtcgagtatagtggctcacacctgtaatcccagcgctttgggatgccgaggtgggcggatcacctgaggtcgggagttcgagaccagcctggccaacatgttgaaaacccgtctctactaaaaatacaaaatttagccaggtgaggtggtgtgcatctgtcatcgcagatactcaggaggcagaggcacgacaattgcttgaacccaggaggcagaggttacggtgagctaagattgcatcactgcactccagtctgggcaacagagtgagaccctgtctcaaaaaataaaaaacaaaataaataaataaaaaataaaaggcattctaattaagttgttgcttttttttttttttttaattccagagcggactgatgtactggcccttagtacaggtgagttccgcctgctcagtaatatgaactcagggctttggtttccatgtggccctaatggactcactctccctgttccagctaaccaacttcagccttgttcctgttcaatggagaacagcttacgctggagtctgtggttttctctgggccaccttcatctgtttttcccagcagagcggtgacggcacattcaagtcagctttcaccattttatatacaaaggggaccagtgccacagaagggtccccggagaaatgagaagtcaaggactctcttaaagggaccacattttgacctaaaatgcacagaattgcctgcagacaaaatatttgatgtgccaattatgcacttcattttgaggaattactactatttatagacccacttttaaaaaaattatcaatgattattttttaattgtattcagacattttttcctgatctagtctgaaatattacttctctaatattttggttaatatgaataacagtggcaaaatggcattttagaattattaatatttctaatattttaatgcaagtttcaggaaacttggtttcttggttttgattgtttacatttctattctaaaatctcaggttatctcctgaacacttttggacagatgaagttttacaccaaaaaatagttcttagagtgaattttaatttacatagaactcaatcgaaatgaagatttaataaccagatttctttccccaaaacatacataatttgttattttgatactaaaatttagtaaatacctttttttttttttttttgagatggagtctggctctgtcacccaggctggagtgcagtggtgccatcttggctctctgcaacctctgcctcctgggttcaagcgattctcctgcctcagcctcccaagtagctaggactacagtcgcccagcaccacgcccagctaactggtggtggtagagacagggttttaccatgttggccaggctggtctccagctcctgacctcgtgatccgccctcctcagcctccgaaagtgctgggattacagcagtcagccactgcgtcctgcccccaaatttgctttgcatggagaaaactctaacaagtcctcttgaacacagttttctgataacccagatcaatgaactacccaggcttcaccactatgcgatataggcatgtgagaaactcgtacttataccccctcaatacattaaaactaaatatatatatatatatatttttaaatcaatgggccaggtgcagtggctcacgcctgtaatctcagcactttgggaggccaaggcgggtggatcacttgcggtcaggagttccagatcagcctggccagcccgcctctactaaaaatacaaaaattagccaggcgtggtggtgcatgtctcccaccacggctgggaggtgtgcccaacagctcattgagaacgggccatgatgacagtggcggttttgtggaatagaaaggggggaaaggtggggaaaagattgagaaatcggatggttgccgtgtctgtgtagaaggaagtagacatgggagacttttcattttgttctgtagtaagaaaaattcttctgccttgggatcctgttgatctgtgaccttaccctccctccactattgtcctatgaccctgccaaatccacctctgcgagaaacacccaagaatgatcaataaaaaaaaaaaagagttctggagatcagtaaaaaaaaaaaagaaacagggtttctccatgttggtcaggctggtctggaactcctgacttcaggtgatctgcccactttggcctcccaaagtgctgggattacaggcatgagccactgtgcctggccccaaatgtgttttacattttcttcctatttgattcatctttgtcctgcaacataaatatgctacttttctaccgataaaaagacaaaatggaatttaaatctggcctggacttctcaaaaaagtcagtgtgatgaaaacatgttctagataaaacagaaatgagactgggcatggtggctcatgcctggaatcccagcgccttcggaggccaaggcaggagaatcacttgaggccaggagtttgtgaacagcctgggcaacatagtgagaccccagatctactaaaaatttaaaaattagctgggcatggtggtgcatgcccatatgtctggaggctgaggcaggaggatcgcttgagcccaggatttggaggctgcagtgagctatgattgtgccactgcactccagtgtgggtgacagagtgagaccctgtctctaaaaaaaaaaaagagagacaagatgatcaggatgagcgcagtggctcacgcctataatcccagcactttgggaggccaaaccaggtggatcatatgaggtcaggagttcgagaccagcctggcctagatggtgaaaccccgtttctactaaaaatacaaaaatcagctgggtgtggtggcgcacacctgtgatcccagctactcgggaggctgaggcgggacaattgcttgaacctgggaggcagaagttgctgtgagcaagattacaccactgtgctccagcctgggcaacaggaatgagactctgtctcaaaaaaaaaaaaaggggggatgatcaaacacaatgcatcaacctcccggagccatataaaccctaaccctaacccaggaagcaggcaagcctgtgtgtgagtttccactctattgctggtaccactcggctctggcaacccggaaggccaccttcccctgttgttactgtgtaaggaggaaggagcactggtttgcaagtcagaagcctgggttgaagcctctgctcgggttcctgctggctgtgggaatgtggggttacctttcctggctggcctcgtttccttcatgtccaatgcaggggttccagtcacatgcattgggcaccattacatgtccaagctgtgccaggatctagaaaaatggctggactcaggccaaggggccttcctgtctggcagtgaaaataagaggagataccaagggccctgagtctggaggggaagtcatgagcacagggcagtgccagggcccgggagctgccacagaggagcccaccttggtgacagacacctgtaggcacatccgtgatgcccagtgcccaacacagggaactggacaaacgtttcatgcacgactcttttttcccttcttggctaccttgaggaccttgattataatagttatcctttttttctttttctttttttgagactcttgctctgtcgtccaggttggaatgcagtggcaaaatcttggctcactgcaatcttcacctctcaggttcaagtgactctccttcctcagcctccctagtagctgggattaccggtgtgcaccactaggctcagctaatttttgtatttttactacagatggggtttcaccatgttggccaggctgatcttgaactgctgacctcaggtgatctgcccacctgggcctcccaaagtcttgggattacaggtgtgagccactgagcccagccggattataatagccttttcatgcaccaggggctttatactcattatctcatttcattcatatgagttgaagtcagcttaccccccatttcacagatgaggaaaccaaggcccagagaggttaggaattcgtccaaggtcacacagctaggaagtaggattcaaacccagacagccaggctgtaacacctaggctcttctcaggctcatgcccttcccaggggtctgggaagccctgacctgcagcctgtcaccttcgtttaccccccagcctccaggatattatgtgtgcaccggcgtgggatcctggaactggcaggaattgtgggttgtgttagtccctagactcccatcgcctatatgaaatatggttccttttgtggcttgggaggccatggccagccctgcgatgccattgactggtgagtgcatgcctgggaccaggctacaaaatccctcacactctggggtagtcaaggcttatgaggaagtacccaaaactgaagctggggtttggtccagggagatcccagtgtgcagtactactttgcaggcaggcagaggcctcttggataacatggccagtgaagccagatcttggtaccagctgccccttaccctggccatgggctgaaaacgttgccttaaaaaattggccaggagcggtggctaactcctgtaatcccagcactttgggaggccgaggtgggcagatcacttgaggtcaggagttcaagaccagcctggccaatatggtgaaaccccatctctactaaaaatgcaaaaattagctgtgtgtggtggcaggcgtctgtaatctcagctactggggagactgaggcaggagaattgcttgaacccgggaggtggagtttgcagtgagttgagattgcaccgctgtattccaacctggacaacagtgccaaaccctgtctcaaaagaaaaaaataataataatataaagtggccaggtgtgttgactcatgcctgtaatcccaccactttgggtcgaggcaggaggatcactggagcccaggagtttgaaacgagcctaggcaacagagtgagaccctgtctctatattaaacacacacacacacacacacacacacacacacacacacacacacacacacacacacacacacacaaaggcagccagactatgcactaggaactgccctgggaatctctttgtgttctcacaacaatcccatttcacagatgaagaaacctaggcacagaaatattcagtaacgtgtccaggtgcggtggctcacgcctgtaatcccagtactttgggaggctgaggcaggcagatcatgaggtcaggagttcgagaccatcctggccaacatggtgaaaccccgtctctactaaaaatacaaaaattagctgtgtgtggtggcaggtgcctgtaattccagctactcaggaagctgaggcaggagaattgcttgaacccgggaggcagaggttgcaatgaaccgagatcacaccactgcactccagcctgggtgacagagcaaaactccgtctgaaaaaaaaaaaaaaaaaaaaagaaatattaagtaacttgtctgaggccacttagttaccaagacgtgggagctgggacttgaacccaggcagtctggctggattcatgcctgcagcctctgcactcctgctacttactgtgtgagaagcgcctgttctgtggaaggttgtgggctgagatctttccatgagttccactcatttacccccaaggctgttcttaaagacgggcatgacagttatgcccattttacagatggggccctgaggctcacaggggcatgccactcacccatttccacaaagctatagttagttagcagagggcagaattcggccgcctctcccctagcttgaaggctgtgattgacacagaggtttttttgttgttgctgttgtttgttcctttttcttttttttgagacagggtcttgctctgtcatcccagctggagtgcagtggtgcgatgtcagctcactgcaaactctgcctccaagatgcaaatgattctcgtgcctcagcctcccaagtagctggaattacaggtgtgcactaccacgcccagctgttttttgtagagatggggttagtagagatttgttttatagagacggggtttcaccatggtctctactaaaccctgtctctactaaaaatacaaaaattacccaggcgtggtggcacatgcctgtagtcccagctactcaagaggctgaggcaggagaatcacttgaacctgggaggtggaggttgcagtgacccaaaatcatgcactctagcctggggtctcgcttttgcccaggttagagtgcagtggcacaatcatagtggctcactgcagcctcaaactcctgggctgaagggaatcctcccacgtcagcctcccaagtagctaggactataggcatgtgccatcatggcgagttaattttttgtgtgtttttattgtcttgagacagagtcttgctctgttgctcaggctggactgcagtggcatgatcttggctcaccgcaacctccacctcctgggttcaagcaattctcctacctcagcctcccgagtagctgggattacatgtgtgtgccaccatgcctggctaattttgtatttttagtagagacagggtttcgccatgttggtcaggctgctctcgaactcctgacctcgtgatccacctgcctcggcctctcaaagtgttgggattacaggcatgagccactgagcctggcctggtgagctaatttttaaatttgttatagagacaagagtctctcttatgttgcccaggctggtctcgaccccctggcctcaagtgatcctcccacctcagcctcccaaagtgctgggattacagatgggtgtcaccgcacctggcctccgaggaggatttcattataaacctgccctgaagggagggaatccaattttacgagagggtgtagcctggtgaggcctggatgacctccggaggcaggggcttgtgcctgggctgaggcctaagggacaatgggcagacatgaagttgccccaggcagagggtacagtgtgggcaaagtcaggaagtggcagggcttggatcactccaggaagagagaggagtcatgtgtcacaggagctcgagacccagagagtgaggcaggcaggcagggaccaagcttgggcacagccaggaaggcaggacagggcatggtggggccaatggaatcattacccaagacgggcattttcagggaaacagcttagataaggccaggcgtacagtagctcccacctgtaatcccagcatttggggaggctgaggtaggaggactgcttgagcctgggagttcaagaccagcctaggcaacatagaccccatatccacaaaaaatttaaaaaaggagtttgtgttcctgtagtagcatacttgggaagttgaggtggcagtatcacttgagcccgggagttcaaggctaaagtgagctgattgagccattgcaccccagcctgagcgacagagagatatgctgtctcaaaggaaatacaaattaaaaaaccagccgggcatgctggcgtgtgcctgtagtctcagctacttgggacactgaagtgggaggatcgcttgagcccaggagttcaaggctgccgtgagctatgattgtgcctctgcagtccagcctgggcgactgcagactgcaggacttttttaaagaccctgtctcttaaaaaaaaaaaaatcttagataagaggatgctgtgcctccctgggggtcttcagtcacccatggtcctggcaagagaggagggccaggagagagcttcacccacctgctgtcctgcccgtgtgacatccgcaggtgctgccatggccacgactgttgttacactcgagctgaggaggccggctgcagccccaagacagagcgctactcctggcagtgcgtcaatcagagcgtcctgtgcgatgagtccccagcagcaccatgccacccaccccgagtatcccctgggcaccctggcatagccagatgacttccgtgcccctgttgcaataaccactgcttccaagtctctgtagaccaccccttgggtatatctaatgtaagtgatatttattttatttatattttttgagtcagagtctcactctgtcacccaggctagagtgtgctgacgtgatcttggctcactacaacctctgcctcctgggttcaagcgattctcatgcctcagcctcccaagtggctaggactacagacatgcaccatcacgcccagctaatttttgtatttttttcagtagaggtggggtttcaccaagttggccgggctggtctcaaactccccacctcaagtgctctgcccgcctcggcctcccaaagtgctgggattacaggcatgagccatggtgtctggccctaatgtgagtgatctttaacactgagcacttgaaaaagaaaaccctgaagaaacctaattattcgatgtctggacgacaaggaagaagatagaaatggcatcagataataaacagtgtaaatgtttgtttatcagaaaggggctggtggtcgggacaagtaggaggatcgcttgagtccaggagtgcatctctacaaaaaagttaaaggattttttaacattggccaggcgtggtggcacacatctgtgatcccagctacttgggaggctgaggcaggaggattgcttgaagcccaggaggttgaggctgcagtgagctgtgatcgagccactgcactccagcctgggtgacacagcaaaatccagtctcaaaaaaaataataataatattttacataaccaaccacttctaaagattaaaaaaaaacccctatgattaaaaacctcaggtccctcaggcaatcataccagatatcgaaacaaagcaataacataaggactgcagtatttattttatttttatattatttatttattctttgttagtttttggagtgtgggttttgttttgttttttgaattttttattttgttctactcggttttattcttattgctcaggcttgagtgcactggcctcttctcagctcaacctccgcctcttgggttcgggtaatgatggttccacgtcagcggccctccgcctcttgggtttgcgtgacggttccacgtcaccgaccctccgcctcttgggttcgggtgatgatggttccacgtcagcggccctccgcctcttgggtttgcgtgacggttccacatcaccgaccctccgcctcttgggttcgggtgatgatggttccacgtcagcggccctccgcctcttgggtttgcgtgacggttccacgtcaccgaccctccgcctcttgggttcgggaggtggttccatctcagccgccctctgcctcttgggtttgcgtggtttttctgcctcagcctcctgagtagctaagggaggtgtcttgagattatcatcggctgagggtggaagcggcccccgcagacgctcggcaggtgtcttgatattatcatctgctgagggtggagctgagggtggaaggggagtgagctgacgctcagaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatcggctgatggtggaagcggaatccgcagacgctcagcaggtatcttgatattatcatctgctgagagtggagctgagggtggaaggggagtgagctgacgctcggaaggtgtcttgagattatcatccgctgagggtggaaggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaaggggatggagcagacactcggcacgtgtcttgagattatcatccgctgagggtggagctgagggtggagctgagggtggaaggggagtgagcagacactcgggaggtgtcttgagattatcatccgctgagggtggaaggggagtgagcagacactcgggaggtgtcttgagattatcatccgctgagggtggaaggggagtgagcagacactcaggaggtgtcttgagattatcatccgctgagggtggaaggggagtgagcacacactcgggaggtgtcttgagattatcatccgctgagggtggaaggggagtgagcacacactcgggaggtgtcttgaggctcagggagttatcagttatagaatgttgttgagttggaggaggtggctggtggcccatcctgttttttaaagtttcagctgtgaggtagggccagtagggcaatcctgaagaatgacgatgctccgctgccgccattctgacctgtagggccaaaggagggaatgttttcacacatattcatttgatggacaaaattaccgccaccaacacagtctgcaccttctgttgctggtgatagatttttgcacctttccatcctccaggtttcaaaatagcagtatcagtgtcataatatcacccttccactgagtactgccgacagctggagggtaaaggaaagtcattgggacacactgttgtctccacatgccactgtgtctgtctgcaaatgtaggcaggctggggtcctgccccagggaagacagagtcataacagagtaataaagaagcatgtttgagacacaggagtgtctatgtctatcctcattcctccctcacagccatcaccagagcatgtttcttgcaccaggtcaacagacagtaagagacagtaagagaggcatgaaaagcccactgtccacacatgttgcagcttctttttggagaatgttttccaggccttttatgttctgtctctgactctcagaactctgcaaggtcagtgtgaccaccctgctccaaatctaagaaaacagaggtttccagaggaaggagaaattgtgcccagggtcacacagcttgcaagaggcagagtggaagttgattccagctctgcctgcaggaccctctcatttcccctctgtttcccttcttgacaaaggatcttcttcactctggaggtgccacccatgagaacaaagagctctggagagatgtggattcctgaagagctgcaggggaactgggagagggttttctgacagaacaatctcacctcaagaagtcacttaggcatggctgtaatatttcttttcactcccaggtaataccaaattgtaagtgcactaggacataaagaatacttttgtccatggaaaaatgaggtgggaattctaaacaaagcaagttttaaaactgtgtttcacttcaagtgtacaagtcccatcacgtgtaatcataggactcggcagcttttgaaggtacagaggccacacaagaaccagcttagctgagcatcatttaaggccttcatttggaattgtccctgtgggtaataagttacattcactcttcactagtttacagtcagggcccatctgctattacaaatacggaacctctgacacttagaatattagatcaggggccccactgggtggggatgaaggtgtttttgcacaacacggttaccaacagggatgggactgtgatgcttgtaggcagcctttctctctgccatctccctctgcagggcttgagcacagagctgtagggagaaaaatgtatccatgtcctgacctggcagactatgtccaaaagcaaggaaaacaagcaaacttacccagttgcaaagagcctttcttgcagaaggggggatctgaaaaagccaacacatgagaaattgaatgttgagagagtctaagggccgtggcatcatctgcatcagcactgaactatcctgcaactgcagggaggaagctccttactttgcatttgtggtagtcctctgcccgccgccgcaactcttgcgcacgttgaaacattttcctatggattacaatcactttcatcagataaagcaccactttcaggatgattttaaataatctgccatgtttctgttatcctcacaactgtacccttacacaatctatctctacctagaaaacgtatttcagatggctataagagtacagtctgagccggtcacggtggctgacgcctgtaatcccagcactctgggagggcggggcagatggatcacgaggtcaggagattgagaccattgtggctaatatggtgaaaccccttctctactaaaaatacaaaaaattagccaggcgtggtggcaggcacctgtaatcccagctactcgggaggctgaggcaggggaatcacttgaacctgggaggcggaggttgcagtgagccaagatcacgtcattgcactccagcctgggtgacacagcgagactccatctcagaaaaacaaaaacaaaaaaactgtacagtctgatccaaactgttgctgtattgattcctcctcttgcttactgcctgctgacttctgagatgatagtttccttccccattctcagtacatccctaattcatccttcattgagcatcttttatcataaagctgtattctctttgtattaatatccttaccgtgtttcacagggcagaaacagctgggcttataaacaggcatagtccttttgaaggatgtggttgatcctacaacaacacactttcctaaggatgacaacaactcaccccacccctagaatggctggtatgaaccgagtttccacacagtctagctggcaatggggtcaggagacgttttgctacttcacatcttttggtcactggtaaatattaaggtactttgttttctgttttgtgaactctctctcgctctctctcacgatatgtcttctgaccgtttgtttctatttctgcatttactgggtctaaatactgtacaaaggttaaaaacaacactccaatgggcgtttcccaggagggtggggttcagtttctgaactcacttgtaggtgtgtatttctttcatatccaatttcccattttcctctgcctctgatacctgcctctccttttctgcatgctcacattctttcacgcttagtttcctcagattagaagggagagaaatgcacacacatgatccaccagcccgtgtgggattccctctgcccttctggcatctgaaggctgtgattcaaagatcccccctgcaaccttcccacaaatgaaccaactgattctcacaaccgaagggagaattgacacctcccattgagggacaaaaaaaagtcacactctggcctgctggcaagtcacctgtcatttccagctcatcttcatagttccatagttagtcctattctttagtaaatataaagactattaaaagcttctatgaggtgcactatgtgtgtctctggggtcagtcttgtgcttgacacagcgaaagctcattttagttcagtgtgaaaaaccagacctcaccaattcatcacaactaactccatcggaagcagaggattgctcctcatctgactcctcctgtgtgagacctgattctcagtcagaggctgatgccggaactgagaccatcagccatagagagatccttccagaataaccccgcagttcactactgcactttgccatgattcaggactggaactcttgtcatcgactttaaagatcctggttgagagaaaaggcaatctgaatgctgggcgcatctattgaattagaaatgatcggaatggctcctaagtcagggtgttatgtcctgaaaataggtgacaacggcaaaccatccaccctggtgttgactgactttaacaaggttcagttcacagagattgagggcagaaaaaggaaacggcctaaaaagggtaagtttgctgtgttgccctcactccacttgattcatggtcctgatcctaaggatctcacctgatacttggttttataggaaggatgtgtaaaattcccagaacgctaggaaacaggggcgaaaacacttcaaagagaaagttaatgaacttgtttctgaccacaaggcatccttcagcacatgctgtctggagtggcctcaaacaaggagtgtgtggtgtggtgctgagaatgcaatgggagcagggtcctgtccccacgctaaagaagctcacagcttaatgcaaatgagaagccagtgaggacatcactactcctgctgtgcacttgggaactagaaacacaaaacctgactctggagggaagctaaggaagcattctactcttgagttgacataagtgcatctgaagcttctgatctccgatgagaacaatgggggacaccaaacagaatataaaacccatgattgaatacatcaaattgctaacatggcagtaaacagacatgaggtgaagatggagaagaaggaaacccaggacgaaagtcagcctcgcatttggaacccatttccctgagtttcattgctgaattccagaaggaactactgagatgcaaagaagcacagcagcttttgcacacatgcgtgggattagatggaaaacaagtggattgagggtctgccaatgaaagcgacccgtactgaagtccactggctctggttgagacccagaagagtcatgcatcagaataaaggtggacaggaaataccctggcctttgtagggactgagcctgcaccgacgacttcaattgcagcctgtatggaggacccctgaccatcccccagaagtagactcccatctcttctgcagcaagataacatgctactaggcctcaattcattgctaaacattttttaacaagtatctcacatttaacaaaaaaagatcagtcatatggcagcaaaatacaatgtcatatgaccaaaacatgaaagactgtgaaaatgaatctggaggtgacccaagcattgaattcaacaatccaggctgggtgcggtggctcacactgggaggctgaggtaggcagatcacctgaggtcaggagttcaagactagcctggccaacatggtgaacccgtctctactaaaaatacaaaaattgggccgggcacggtggctcacgcctgtaatcccagcacattgggaggccgaggtgtgcggatcatgtcaggagttctagaccagcttggccaatatggtgaaaccccgcctctactaaaaatacaaaaattatccgggcatggtggcatatgcctgtagtcccagctactcaagaggctgagggataagaatcgcttgaacctgggaggtggaggttgcagtgagccaagatcatgccactgcactctagcctgggtgacagagtgagactctgtctcaaaaaaaaaaaaaaaaaaaaaaattggtcaaatgtggtggcacacacctgtaatccaagctactcgggaagctgaggcagaattgcttcaaactgggaggcagaggttgcagtgagccaagattgcaccatagcactccagcctgggcgacagagcgagactctatctcaaaattaaaaaaaaaaaaaaaaaaaaaaaaggctggctgtggtggctcacgcctctaataccagcactttgggaggctgaggcaggtggattacctgaggtcagaagttcgagaccagcctggacaacatggtgaaaccccatctctagtaaaaatacaaaaattagctgggcgtggtggtgggcacctgtaatcccagctacttgggaggctgacgcaggagaattgcttgaacccaaaaggcagtgagctgagattgtgccattgcactacagcctgggcaacaacagcaaagctccatctcaggaaaaaaaaaaaaaaaaaaaagagaaaggaaaaccaatgccagtactagcaactcctcttcctccgaaaaaatgaaaacaagaatgtaggaagggaaaggaattatacagcttaaactaatgaagcagaaaggacaaactcaattttgaacccactgaatttgccacaaatattgtagaaaatattctcaaggactttacagttgtctactttgattggcacatggttcatacaacagtatttgtgtcaaggcacatcttactgttttctggcggtcttcctctttccattgattttgtcatgatggttgattttcgttgtcaccttcctcttacggattttagctctaacttttgtttccacatgtctccgtagagtaatgacgtctttcaggccaattttatttcctcgaaaggaagaaactcttttctttgtgtgcatacaaatggacctcagcccttggtgagagtgaggagaggagaaggtgagaaacctgagggcaagaagctgttctttccctttccagggcaaactcatttccacactatgcggattccaacagagccataccttcctgtctacggcggttggacctccaggctctctgctgtacatccgtggatccatcatgtccatttcgagaccagaagatagtcttcaggagagacacctaggaaataataatataagaatgacggctgggcacggtggctcatgcgtataatcccagtacttcgggaggccgaggcaggtggatcacggggtcaggagttcaagaccagcctggccaagatggtgaaaccccgtctctactaaaaatacaaaaattagccgggcatggcagcgggcgcctgtaatccaagctactcgggaggctgaggcagagaaccgtttgaagctgggaggcggaggttgcactgagccgagatcacaccactgcactccagcctgagcgacagaatgagactctgtcacatacacacacacacacacaagaatgacatgaggctggcacggtggctcactcctgtaatcccagcactttgggaggccgaggcaggcggatcacctgaggtcgggagtttgagaccagcctcaccaacatggagaaacgctgtctctgctaaaaatacaaaattagccaggcatggtggtgcatgcctgtaatcccagctagtcgggaggctgaggcaggagaatcacttgaacccagcaggaaaagcttgtggtgagctgagattgtgccattgcactccaacctgggcaacaaaattgaaactcttgtctcaaaaaaaaaaaaaaaaaaaaaggccagatgcggtagctcacgcctgtaatcccagcactttgggaggccgaggcgggtgaatcacaaggtcaagagatggagaccatcctgggcaacatggtgaaaccccgtctctactaaaaatacaaaaattagctgagcatggtgatgcacgcctgtagtcccagctactcgggaggctgaggcaggagaactgcttgaacccaggaggcagaggttgcagtgagccaagatcccaccactgcactccagcctggtgacagagtgagactccgtctcaaaaaaaaaaaaaaaaaaaatgacatgaatatacttcacacaactgaactgtacacttcaacacggttagatggtaattatcatcttataagtattttaccacaggttaacatgtttcacaacttgaaaaggaagtaattaccttcagctctctgagttctagaatttgtaacatttcatcccctgctccttcctgatctgcactggagcatcttccttctgtccctgctctactcagagttcactttcccttccctcacatcagcttcattgaggctggtttgaacttaacgcaaaacattctcactaatgactgaattcccaccaagatttccatattatcacagtatgcttttaatcttctaagatattaaatatttcttctcatcatagctaaaatgcaatgcaaatcccatctcagatgtgggtcagatacctatgaatctcctgaggtggtcattgaaatgactttttcttgagacagagtgtcactctcaaccatgctgaagtgcagtggcgctaccttggctcacggcaacctccacctcccagattcaagcgattcttgtgcctcagcctcccaagtagctgggattacaggtgcctgctaccatgcctggctaatttttgtctttttagtagagatggggtttcaccatgttggcccatctggtcttgaactcctgacctcaaatgatccatctgcttcagcctcccaaagtgctgggattacaggcatgagccaccacacctggcctgaaataatatctttcaaattctttgtagaatttgttttttcctgatttctgcacataggataaaaaaaaaatcatgtactaggatttcgagagaagcaatgggtaatctaaaaagatgaaaagagcaaccacgtcaatcccacagctactgctagatttcataggaaaggtagctggcccagtttggagctaggggaaatgtcaaacacatgaagaaatgagaagccaagaaatgccatcacgcatgaatgcttcatggcacccatgatgtccctgcttaggaggtaatggtatagatgactagatgacaaggacaaagatgagaggtgcgaagttgtccaagtccaacagctcaactgaactttcctaagtggaattgttaaaaagtggtaaatttaaaaacttcccctggctcacgtggtggctcacgcttgtaatcccagcactttgggaggctgaggcgggtggatcatttgaggtcgggttttgagactagcctggccaacatggtaaaaccccgactctactaaaaatacaaaaattagctgggcatggtggtgggcacctgtaatcccagctacttgagaggctgaggcaggggaatcacttgaagccaggaggtggaggttgcagtgagccgaggtcacaccattatactccagcctgggcaacagaaggagactcgtcttcggggtgagaaaagaaaaaaaaaaaagaaaaaagcttcctccaatttataccgaaaattctctgttcaggactaagtggcatagagaatgttaaatgtgcctagatatcttcataactcatatattttctgttttctacatatcttgaaaggcagtgccaaatgacgtgtaattatctaggtggtaaaactgaaacatacttcctcttcccttgaatataaaaaagcattgtggtattagtacttttatcttggatcattgttcagaaggaggttcagcccccagacaaccacatttttactgtcatgaatggcaagacaaaatgtagagctcaacttacccaaaggaaaaaaggctcaaaagacaaattatggcacaacttagcagccaaattcttaccaagtacagacttttgacatactgatctctctccagttccaagtcggaacatgcactttgaatgatgtcattcaaaattaccctgcccagacacacttttcattgattctcttggagggcagttctaagagtctctggggctttctctgcatcatgagacgcagtgcagttctgcccttcaccttccggcagtttgtcacctcgtccctatgacctcacaggaactttgtctcaggccaattgtttgttccttggcctctttcatttcccctaaaaatcatttgctgcccctctaaatggcctacatctccatctatctccctctcccctcagaagagggtgctctttaagcatcagccatccggcccttctagcagtctcatttttcagctggttcccatgtttatgcctgttctatgtttttcttttcctgttaagctgtctgttgtcagctcatttctgcagtgaatcttcagagaagagattggaagctttccttccacccatacgatagaactacaaagcagaagagtttagaaagaatttcctatttaagtgacgaaacctcatactccatttgtgataaatagcacaaaggttaaaaaaacttatttttgaccaaaagctctgttgacattctattaaacaaacaccgacctatttaattttcataatgcaaatggcagatgttttcataattcttatactaataaatcatttccctgattttttgggtaaaaccacatattcataatgaagtccagaaatgtgaattgttttatataatttattcttatttgtgattacaagtatacctctacagaaagttagtatactcacccaaaggtaaactatccagagggtaatgacaactttataacttgtcggaaacgcaataatgacatgtaaccaaggacttccaccaaagtcagtcccacgatgatgatggtcagccagagtattgataacctggaataataatagttgaaataatgaaaaggtcaatgacactgacaatatttcactcagaaagaatcatccttagaaaccgtcaacctcctccaaaaggtaaccacatccctcagatatcaccgtgggattccactgctacaaaaaagaacagaagttagaagtcacatgtttttcagatggctggtagtgttttcaggcattgcaaatgtggggtgttgtctttcttggtataaagcagggatatccaatcttttgacttccctgcctatattaaaagaagcaaagttgtcttgagccacacataacatacactaacactaacaatagctgatgatctaaaaaaaacctcttttttttttttgagacagagttccgctccactcagtcgcccaggctggagtgcagtggtgcaatctcggctcactgcaacctccagctcctgggctcaagccattctcctgcctcagcctcccgagtagctgagattacaggtctctgccaccatgcccgactcatttttgtatttttagtagagatgaggtttcaccatgttggccagtctggccttgaactcctgacaggcgatctgcctgcctcggcctcccaaagtgctgggattacaggtgtgagccaccgtgcccagccatttttttgtttttgtttttgtttgttatttttgagatggggtctcactctgtcacccaggctggagtgcagtggtgtgctcccggctcactgcaacctctgcctctcaggttcaagtgattctcctgcctcagcctcctgagtagctgggagtacaggtgcctgacagtgcactcagcaaatttttgtagtttttgtggagatggggttttgccatgttggtcagggtggtctcgaactcctgacctcaggtaatctgcccgcctcagcctcccaaagtgctgggattacacgcatgagccactgtacctggccaaaatctcctaatgttttaagaaagtttacaaatttgtgttgaactgcattcaaaactgtcctgggccacatgcagcccgtcactcatgggtaagacaagctaagtataaagtaattatcttatcttttcttttctttttgttttgagacaaagttttgctctgtcacccaggctagattgcagtggcatgatctcaactcactgcaacctccgcctcccgggttcaagcgattctcctgcctcagctactgagtaactgggattacaggcgcctgccaccacgctcggctaatttttgtatttttagtagaaacagggtttcaccatcttggccaggctggtctccaactcctgacctcatgatccacctgccttggcctcccaaagtgctgggaatacaggtgtgagccactgcacctggccagtagttatcttttctttaaagttatttacttgttttttaaattgatgtataacattggatgcatttattatatatcacatggtaaaagaatccctctaaataatacttctctcttggattatatgaatctttgtcatttaaatctcagcataagtaaaaaaaaaaaaaaaatacaatgaagagattacttcattcacaaataagtatcaaattttagtgcttaaaaattaacaaggtgggctgggcgtggtggctcacgcctgcaatcccagcactttgggaagccgaggtgggtggaccacgagatcaggagattgagaccatcctagctaacacggtgaaacccgtctctactaaaaatacaaaaaattagcagggcatggtggcacgtgcctatagttccagctacttgggaggctgaggcagaagaatcacttgaacccgggaggcagaggttgcagtgagccgagatcgcaccactgcacttcagcctgggtgacagagcgagactctgtctcaaaaaaaaaaaaaaaaaaattaccaaggtggagatcatgaaaatggcatgaatagtgtgggatttctctaagattgttgatattaattccattagactcttatgtgagtgaagacgaagacttcccctgagtaagttcagacagcttctgataacatttctacgtcgattcctcaggatttaactatatattcttgaaaacatctcaattttaaatgtttctttcaagatggtgaattaaacagagatagcccttcaacaggttgaactcagcatatgctgagtctgaaatggaaatgatgaagttagagaaccatacaacaatggtaatgatttcagaaacatggtgttgagcagaacaaagcagacacaaaagagtacctatggcatggcatgcatctgtatacgcgaaattccagaataagcaagctaacctatgataagaaagagactggctgggaagactgagagttcactttctggggtgacataatagtgtagatcttggctgggcacggtggttcacgcctgtaatcccaacgctttgggaggccgaggcgggcggatcacctgaggtcgggagttcaaaaccagcctgaccaacatggagaaaccctatctctactaaaaatacaaaattagctgggagtggtgccacatgtctgtaatcccagccactcgggaggctgaggcaggagaatcgctcgaacctgggaagcagaggttgcggtgagctgatattgccccattgcactccagcctgggcaacaagggagaaactgtctcaaaataaataaataaataaataaataaataaataaataaaataatgtagatcttgaaagggggttggtttatgctggtgtatgtactttccaaagttagtaaacttacacttaaggttatatattttggccaggcgcggtggctcacgcctgtaatcccagcactgggaggctgaggcaggcagatcacgaggtcaagagatggagactatcctggcgaacatggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgaggtcccgccactgcactccagcctgggcgacagagcgagactccgtctcaaaaaaaaaaaaaaaaaaaaaaaaaaaaaaaaaaaaaaattagccaggcgtggtggtctactaaaaatacaaaaattagccaggcgttgtaatctgagctactcaggaggctgaggcaggacaattgcttgaaccccagaagcggaggttgcagtgagccgagatcttgccactgcactccagcctgggcgacagagtgagactctgtctaaaaaaaaaaaaaaaaaaaaaaaaagtcatcaaaccagatgacacaaatcaaatgacatttcactttgttttggtccattttctttgttaaaaacaagagtgcagcggggccatctcggctcactgcaacgtccagctcctgggcccaagcgatcctcccacctcagcctctccagtaactgggataacaggtacgcaccaccaggcccgactaatctttattggaattttttgtagagatggggtttcgctatgatgccctggctagtcttcaactcctggactcaagtgatctgcccacctcggccctctaaagtgctgggattacaggcctgagctgtgtaatttcatgccacgtgatacagcccagtaaaaaggaagaaaccccacgggtccagcgtctactcacagagatgcactgatggctgataaattccagtaggagcccaaagaggagccaaaagagcatccaccgcacccgcatgtcctggtcctttcagggcgccctgaggcggccaggacagaggtggaggtggcttagggcaggggggagggaaggggacgggaccggggccggatctgagttggggagggggaggggagggggaggggaaggggaggggaaggggggaagtaagggaagggaaaggaggagaagggggctgttgggcacctggaggaggtggaggaggaggaggagaagaagaaaggggtctgggaaaggatccggttcaaattaagttctcaagcgctggtggaaggtttagctacaggtcacggagaagatcagggaagcaacaggacacgcggggcaagggagcgtgaggcttaggagcaatcagagggagacaaaaaggttctgctatccaccaaaccttcttcggtctgggccctcccttaccaaccctggggctttatactccctctccaccaatccctgatgaccccggtggtgcctcacaatggacagtgcctcacaatggacaatgccaagtagcgcccgcatcattccaatgacccctcccccatctcagtctcccacactcctcccaaagacaggtcctctctggaaccttcacaaacctgatttctggtcctccccaaccagctccctgtccctgcttctgggcgctccttccttcctgagctcccagggttcctcaaggtcacttatggcgacaaaacataaaaaacaaatgatggcaggatggcaggaagaacctcatacccaagcagagtgccaggttttacagcctccgctcagccattcatatcctaagcaacaaaacatcagcagggtgcggaaggtcccgatagtaaaccatctccatcacatccatgtagccatccgtccatcaacctgtatctcaggaacaaatgtagatacattcattttaagcatgcctggtacatttacaaaaattaacctgacttattttgttccagcaaatctcaatatatttgagagcaatcaaatcacacagcatgtttctgatcatataactgtgctagaagtcaatgattaaaagctaattcaaaattattatttgcttggaaattcaaagtgcccttataagacataaacataagaaagaatccaaaatgaaacaagattgcctttcaactcaatgatgagatcataacatggcaataaaatgtctccctctggcctgggaattcctctttgtggcacaaggttgtgtgatctcaaatcaccgctaacccacctagacattttaacatccgaaaccgagtgatgacgtccttatctatatcatcttactgcctgtgtgtgtggactttaaattctgaacccaaatgagggggagaaaaccaagttgactttcatgactgagctctcagggacgtccaaggaatctgtgcatttcaagaaacaaagttcatcagcttctctcctaaggtatttgcccacaatacccagagggcttggcagcatcatgtgtgatgggtggggagctccaagcaggtgggcaggacccaggggcctggtgaccaggacagacccccactgtccatcaactttcctggccctgtcctctgctaaacttcccacaggccttctgcccgatcacacagagtatgcccaaactctctcaggcctctggcagctgaaaaccactgctttaaatccctttaccatttactatgacataaggttattgtaaacaggaaatattctattgatgctacaaatggaaagccaatgcctttaccataaatagaaaaacaaccctaagaagcaagcaaaacaaaaacaaaacgggctgggtgtggtggctcacgcctgtaatcccagcactttgggaggccgaggtgggcggatcacaaggtcaggagttccagaccagcctggccaatatggtgaaaccctgtctctaataaaatacaaaaattagccgggtgtggtggtgggcgcctgtagtcccacctacttgggaggctgaggcaggagaatagtttgaacccgggaggcagagtctgcagtgagccgagattgcaccactgcactccagcctaggcgacagagcgagactctgtctcaaaaacagcaacaactacaaacaaacaaaaaacagggttaacaaaagtatggaattcaattctttttatatgctgcagccatgttcctgccctagatttggctgggcatggtggctcacgcctgtaatcccagcactttgggaggctgaggcaggcggatcacgaggttaggagttggagaccagcctgaccaacatggtgaaaccccatctctactaaaaatacaaaaattagccaggcatggtggcacacgcctgtaatcccagctactcaggaggctgaggcaggacaatcccttggacccgggaggcggaggttgcagtgagccgagattgtaccattgcactccagcctgggtgacagaatggaatgagactctgtctcaaaaaaaaaaaaaaaaaaaaagcagccctagatttcggttgtggtggttgtaaaaggagagaccaagtaagtgggggttgaagtcagattagagcaaaagtgaatggcagagagtactataatgtccatgaagggctgctagagtcaccgtgatcatagcccaagcagagatagggaaaggaagatgtgagcagagtttggggtctcgaacaatggaggttattcgtgcagcccaggaaaggctccccaaagccaggatcaacctcccttggaggcggtccctcatggaggcatggtcaggcaccttagatttgagaacagctatgttgctgctgaccagctgtgtgaccctgggctggtttccttccacacaatgggagtgccaatggctgcatgcatgcaaagaccgtctgaggataggaggaagcaatctgttgagcacccgtgtacctgagtgtcatcacctcccaagggcatccttcgttccagagctggcgccttggaaggcccttggtcactgaaggcagtgatgatggtaacagcagtaaatcatcatttacggctgatgagggaaggccaggggtagggctcctaggtcctggataagaatgagggtctgggcactcctggggacagctgagtggtaggactcctgggtccccagggggaaggtccatcttcagtggcattgggcctaggctgggatgctgagttatccactggagcatcagcagtacaggcaggcacagaggcagtggatccatcggaggtggcaggtgtaggatcgtctggtgagcaagtagagtcaccaaatctggctgaccactacccccactacccccactatccccacagacgatgccctgtcccttgcctcatgctccggcagggtacaggctcgcacctggggcctcaaggagcatctctctaagacctctgtgtcctggtcattgaatgggcacttgagtcacccagggccattggaacaaagaggaagaatcaggccccacgatgttttgggagagtgtttagcacaggaaaatgcgcagaatacatgcacgacacgggggcactgtcagtgtgggagcaatggtttacaacctccagccctaatctgagcactctcacctgtgcaatctgaaaggaacaggagacttgcaggaaagacagtgcctggatttaacttaaaggaactaaaaatgttggaatttttactcttgatatccttccaaatcaactctctcaatgttcccatcctcaaaactatcatatggggtaactgaggcagtcagagatttactgactcaatgtcactcaattgattctgagttcactgctgattacatccgaccaaactgctttttctgaagtctactccgtttaatcatgctggtgatgattttgtgcggctctgggacaaactccacctggctgaagataaagcaaatctgcggtgacttagtcctcctgtcatttcccatcagttccccactctcctcctctgcccctccacagtctcccatgcaggctgacaccatatgacggccttaatggagtccaccgagtatttcaggttctctcctgggccacttgaaagtggatgtacccatgggatttgctttgacccaggagatgtgagtggaagtgaagcgtgtcacctcgaggcaaaagagttgggagccattgagacgggccactctctccttcatctcttagagcagctgacagctcccatatggaggctgctcctttattctcgtggcaggatgagggcatgtggggcacagggcacaggagagccatggaggatgtgcagcatgggcaggaaaagagccttcagtggtgtacatttccatagtttggggctgtttcttacctacagtgatacctagcccatcctagcaggcatgcaccatctactccacactctgtgatgcagactagcctgccgtcagaacacgaactggtggtcagacacaggtaggtttcagttccagctctgcctcttattgactgcaacctcaggcttaactttcagtctctgagcctcagtttcaactctgtaaaatgaggtggctataccatctcaggttgcagagagaattaaatgaaatataagtgcatgtagagcattgaacccagggcctggcacacacagtgagtacacaatgttagccaggtagcttcataatgcatactgattgttaatattcagacaatgcagtaaagtgttaccaaaaataaaagtaaacttatttgcatatgtattctttcaatctttatttttaaacagggtaaaactatgcatattctttcatagccagtgtttttctcttcatagtatattgttaaaataattttacttggaccgggtgcagcggctcacacctaaagtcccagcactttgggaggccgcggtgggcagatcacgaggtcaggagttgacacgagcctggccaatatggtgaaaccccatctctactaagaatacaaaaattagctgggcatggtggcacacacctgtagtcccagctactcagaggctgaggcagaggaattgcttgaacccgggagacggaggttgcagtgagccaagattgtgccattgcactccagcctgggggacagagtgaaactctgtctcaaaaaatatatgtgtgtgtgtgtgtgtgtgtgtgtgtgtgtgtgtgtgtgtgtatctatataaatctcaaaaataaaagatcatttttgagattatcattttaaaagacaagataatgttcaacttaatgactaatttaattattactattggactttttgtagactaaacagagcattcaaaacaaatgaaggagaataaaaaatatgtattacatgttgtaaaataaatgtgatgtggttaactcttttattcaaagttatagaacatatatatgtactatagaatgtatttcttattatgagtcatgttaaaaagtagtttagaagctgttgatttgaatttccttttcaaattttgcaggataatttttttttttttttgacagagtctcgctctgtcgcacagtctggagtgcaatggcgtgatctcggcccactaaaacccccacctcctgaatctaagcaattctcctgtctcagcctcctgagtagctgggactacaggctcacaccaccatgcccggctaatttttgtatttttagtagggacgaggttttgccatattggtcaggctggtctcgaagtcctggcctcaggtgatccaccagcctcagcctcccaaaatgctgggattacaggcatgagtcaccatgcccagcctaaacttggcaagataataaataacctttttaagtgtcgttgggcacttgtctggttgtttttctttaggttaccatgccagcaatgattccttttgagtttctgacagaagatagtggttttcatccaaataagtcaactactctaccccatccctaagccacttgtatggaaagaaaaagaggaagaagccagtactgtgactgcgtaagcttcccccagcatcacccgctatgagatgtgtggcagctgagacccgggaactgctcaagggcaccaggccccatctgtctgcactcactcaccttcctcaggtactcgcatgggcatgtcactgactttacatgctgctgcagctccttggtgagctggccctggtcatgggacaggaactgtggggtcaggacaatagagagcttcaccatttgcagaatgagaacaggggctcatgatgagtgccaacctattagataattttaaaaaaaaagtgttgaatgagtggaaaaacaaggtgatgtttgagtctatagtggtcaagggcttcagaaaaggacagaaccaagttcaaattcctgtactttgaatttctacttcatgccatgcaaaattactttaccccttttaacctcagttttcttctgtgtgaaacaggaacaatagtttcattcgtcattcagtttctctcaaggtttcacgagatcatacctataaaacatccaagtcatttaaatgtatcatcatttctgtcataattagtgggatccatttcactattattggatatacagttctgtgcctgaaacctacaaaaaaagaaaatgttaagtctaaaaagcattagtgatttctcatttttatattactaattataaccctatttaatcacacaaggccttgtccgtggcaggtgctcaataaacacttgtcgaatcaatgcatgtgggctccggagccacactgtttagattctattctgcctccaccacttatcagctgtgtgatctgggtaagataattcacctctttatgtctgcacttccctctccataaactatatataatgagaatccttagctcattcggttgtggtgaggggtgaatgatttggcacacaggaggggcttgttaacattagctgtgatgatctccttccaaatcttcattttcagagccacagatgaggccacagtgcaaccaggtgaccttagagtgtaagtacacgatcgccagctatgctctatctccaccataggtccaagactgggtagttctggcctggaggtttctgctacatctgccttctcagtgttcacctaaggacttttgtattttcctcctcgcatccccacagatggggttcaggctgccggacacagctgggtgatgccagggcagtggtcacctgtgccagccccgtgaggtagctggaggatcattgttccttccttctcgggctctgggcagatgccagggctggggtgacccatgccctcaagtttcttgctttggtgggccacattttcccttggcaaagagggtaaaggtcacaggatgccagagagctgtgacttctctgtgccctgggcccaaactatgaagacctgacacactatgctaaaagtccaaggctgggtgctccccagagcttcttgcctcaccgcttctgctgagggaggaatgaatactatgtcctcccagagctttgggagcttgtagcaagcagcctccccagcgcaaaatctcttggaaacctctaactgtgtctgaaacattagtgcaaatgttgcatcctatttcccatatgtccgcatgttttagaaaaaaatcctcaatttcctaaatatgcaagaaaaatcggtattgtaggacaatgtgactttttaaaaaatgttatttaaaaatcttccccacctccttttctgccctccaagactgccaaatacttgttgaacatatattattaaatgcctactacatgccagccatgattcatggtcttggggacacagcagagaacgaactgacaggattcctctcttatgtaactcacattcttatatgataatgataagggttaacattaattaagctgtcactgcatgttagtcacggtgcagtcattcccacacattattacacttaaacctgccagcaagcttgcaaggtagttgtttttcctttaaaaactgagtctcggaatgatgaagcactctgtccaatgtcacacagctagtaagtgtggagaccttgcatccaatcaatgcccgtctcattctaaaggccatgttatgtgttctccagcccatggagaataattttaacacagtcaatgaaatttctacacaacaatgttcttgtctcaagtccaagaatgcctcctacacctcctataatactggctttctggtgagtaaagatgccattctcatgtgtaatcaggtggcaaatggagatatgaccaaagtaaccatctgcctacactcataaccctgtacacactcttcctgtgtcgattcaattcaagtaccccttttgatcacttagcaaatctgacctttaaaagggttagggtttttatatccatgtaagtttctgtattgctttggaagtctctggttaaattaatactcttttaatagtgacctgtgattctgttttgatcaagtgttttcaaacttgacgtctttgatgggtttctccagtgtcaaaatcctaaatcaagtctttttggcttaaaactaactttgggatttttttcagctgcatcccttggggagtctaaagaatgtatctctcatcttgtagaggtattaagtgattcgatttatttggtagattaaatgggcaggcattgtcaaatgtggcgatactgcatgggagggcactgtcaagtgaggtgacattagatctcatctcagttatatttatgggtatgttgttgatatgcgtgttccaaaaattgcatacatttatacaaatttaatatgatttgtaattttgatagttatgctaaatatttgctaaagttatatttgtataaacatgtcacgaatggctgggcaccgtcactcatgcctgtaatcccagcactttgggagacaaaggcacgtggatcacctgaggtcgggagttccagaccagcctaatagagtgaaaccctgtctccactaaaaatacaaaaattagccatgcctggtggcacatgcctgtaatctcagctactcgggaggctgagacaggagaactgcttgaacccaggatgcggaggttgtagtgagccgagatcatgccactgcactcccgcctgggtgacaaaggtagaatctatccaaaaaaaaaaaaaaaaaagttattatttctgaagattgtatgaaattcataaaagtctgctggccctgatatgatgctgtcagtcatgattctgattactgtcttaaaatgctgcacataagtaattaaatttccttgtgaactgggaagtttcatcagacttttatcataactattgtttccatcatccacagttactgttttgaattcttctctaaaaatatttgtaattggcaatagtccaaattttcttttgttttctttcctgtttttgagacacagtctggctctgtcgcctaagctggagtgcagtggtgggatctcggctcactgcaaactctgcctcccgggttcacgccattctcctgcctcagccacccaagtagctgggactacaagtgctgccaccacatccagctaattttttgtatttttagtagagacagggtttcactgtgttagccaggatggtctcaatctcctgatctcgtgatctccgcgcctcggcctcccaaagtgctgggattacaggtgtgagccaccgtgcccagcctaatttttgcatttttagtagagaggaggtttcaccatgttggccagggtggtctcaatctcctgaccttgtaatccgcctgcctcagcctcccaaagtgctgggattacaggcgtgagccactgcaactgactttttttttttttttttttttttttttgagacagagactcactctgtcacccaggctggagtgcagtggcatgattttggctcactgcaacctccacctcctgagttcaaacaattatcctgcctcatccttcggagtacctgggattacaggtgcgtgccaccgtgcccggctcatttttgtattcttagtagagacggcatttcaccatgttggccaggctggtctcaaactcctggcctcaactgatccactctcattggccttccaaggtgctgggattataggcgtgagccaccacaactggctcagtaaatacattttttattatcaaaaaagagtagtgtatggttggcgtattctgtgtagaatgtattttattgatgtctcctatttttataatttctgagttaagtactttttaattaatgctttttagttttgggcagattcagttgactaaagcacctcatttcccagatacatgaaataaaatatttggcttcttttccaatttcacactgatgttattttgtgaaaatcagtgctttaagataaatcgttatacgttaagataaacatgagaaacttgatctaatatttaatatttattcagttctacactttattaacttctacaccagcagatttagacattatgtaaccatctcaagaagtttcacttggatgtaatgcttcacgcttgtaatcccagcactttaggaggctgaggtgggaggactgcttaaggcaaggagtctgagaccagcctgggcaatacagcaagatcccatctctattttaaagaaaagtttcactttgggaggccaaggcgggtggatcacaaggtcaggagatcgagaccatcctggctaacatagtaaaaccccatctctactaaaaatataaaaaattagctgggcgtggcggtgggcgcctgtagtcccagctactcgggaggctgaggcagaagaatggcgtgaacccgggaggcagagcttgcagtgagctgagattgcgccactgcactccagcctgggcgacagagtgacactccatctcaaaaaaaaaaaaaaaaaaagtttcggcaaattccatctaagaattccaccagagttctgttgtctccaatgtcatcttccacagatttcaagttgtgaagccctgaactgttaatttatcttgagaatgtatatttaagcttaatttaagactatatacctaaaaattgagcatataatttctataatttgtttatgtaaatttctgtaagtcataagtatgtggtttccaagtgtataatttatctgaatgtaataggcattaatatattttacattactgggaccatagtacagaaatttctaaatggtttgtaaaataacttgttatttgtgttgttgtaaaagcagttaatacaatggaaaaactcgtaataagaagatacagtttaacatcaaaaagtttacccaaggtaattatgagtactacctggcaaaacttcacggaagctgtggtatcacttttatgatggaagaatggtgtttgcattttgtgtaaaagtacttgcggctgggcgtggtggctcatgtcccagtgctttgggaggcgaaggcaggtggatcatctgagcccaggagtttgagaccagcctaggcaacgtggcaagagcctgtctctccaaaacctacaaaatttagccaagcttggtggtgtgagcctgtagtcccagctacttgggagactcacgctggaggatctctcgagcccaggaggcagaagatgaataaataaatggaagcaactgaatgggatgaggtctctcttgaaggagagagcaaaagagatttaaatagtaacaattataataaggctgggcgcggtggctcacgcttgtaatcccagaactttgggaggccaaggcaggcggatcggttgaggtcaggagttcaagaccagcatggccaacacggtgaaaccctgtctctattaaaaatacaaaattagccggacatggtagtgcgtgcctgtggtctcggctactcaggtggctgagacaggagaatcgcttgaacctggtaggcacaggttgtagtgagccgataaatataaaaagtattagagtactaacagaggaaagtttccactgatcaccttttagctttaaataatgcagaagcatttgcccagtttacttgtaattaaaaatcatgcatcattcacaatttatatcttttttgtttgtacaaaaatgaacacaagttattctcttttatctgtattgtgattggtttggtgagagggaattaggccacttgagagtttgtgtgtgtttacaattttctggccaggcacggtggctcatgcctgtaatcccagcactttgggaggccaaggcgggcggatcacttgagctcaggagttcgagaccaaattgggcaacatggtgaaaccctatctctacgaaaaatacaaaaattagctgagtgccgtggcttgcgcctgtcctcccagctacttggggggctgaggcagtaggatcgctcaagcccaggaggtggaggttgcagtgagccaagatcacgtcactgcactccaggaagggcaacagagcaagactccttctaaaaaaaaaaaaaaaaaaagaaagaaagaaaagaaaattaactttggtatttcaggttgtatttaaatggagacttaacatgaactatgttcataacacttgaccaaattaagtgtagatcgtctctttaataaagagatcatctggaactgcaatttctaactcatacatcattgctacaaaccttatttgtttactatttctcttccaaggaccatcagtcatcctttaaaattcatttcaagctctgaaaagatattttttgttacatgggcaatttacttttagtacagtaaaatgttatgtgaatttctacagtatgtttgccaaaatgaattatatctagaatacgcttaacaatatattctggaggcagctttcatttgaaattaggttcaccttctgagagtatgaaaaagttaatgggtttttgtgcctgaagattttgatgttgcatttggctacatttaatccactttcacccataagttttaacatctaaaaaaattaaatcactgctaatgcaattaaaatgcattatgaaatgcatttctgtccaggctggagtgcagtggcacaatctcggctcactgcaagctccgcctccctggttcacaccattctcctgcctcagcctccctagtagctgggactacatgtgcccgccaccacgcccggctaattttttttttttttttttttaatgaggcggagtctcgctccgttgaccaggctggagtgcaatggcatgatcctggctcactgcaacctctgcttcctgggttcaagtgattcgcctgccttgctgggatgacagacgtgcaccacaatgtccggctaattttgtatttttagtagagacatggcttcaccatactggccaggctggtcttgaacttctgacctcaggtgatcccaccttggcctcccaaagtgctgggattacaggcatgagccactgtgcccagcttaagatctctgttttaatgttaatgctggtcagttgtgtctggattccagagggaggaaggtagaatgaggcatgttgacacctccccttcccatcatggcctaagctggtcttttcagtttactttggaatgtccttgctcaacaggaagggtccattcagtcggattgggtggcttagaattttatttttggtttacatctcaactatcacagcagccgggcgcggtggcttcacagctgtaatcccagcacattgggaggctgaggcaggggtatcacctgaggtctggagttctagaccagcctgaccaacatggagaaaccccccgtctctactaaaaatacaaaattacccgggcgtggtggtacatgcctgtaatcccagctactcgggaggctgaggcaggagaatcgcttgaacctgggaggcggaggttgtggtgagctgagatcgtgccactgcactccagcctgggcaacaagagcgaaactctgtctcaaataaataaataaataaataaataaacaaactatcacagcataaagtaggaatatttcgttactgtctagttaaactggttaatgcagaaaggaagtctggaaattccagttttaaagtaaaattttggacattgtaggattgattatttggcatagttgtgatgtttgttcctgcgttatggttttgttggcagggcagcctttaaggacctgtatattttcttctagactctatatattccctgtgagtattagttgtatggtcaaactggcaaattttaccataggtataaataatagagaatgtggaagaatagtgaatagtgtcagagatagttaaaagtccatacaatagtagagaaggtaataagtaatagtggcttggactaaatatttgttgaataaatgttttaaaaaacaggctacctacaatttgtgttgaagatatgaatgaatgaagtttccacacctttatgtggagacctgataagtaagcaacaataaggaagggtccccaggttggggagagccccaagttgagaacaataatgaacaatgattgtatgaacaattgttagaaacagctaatcacaaacaacctgcgggcacaatgacctcattccacacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctaggttgttgctacccgatatggtttggctgcgtccccacccaaatttcatcttgaattgtagttcccataatccccatgtgtcgtgggagggacccggtaggaggtaatcgaatcatgggggcaggtttttcccatactgttctcgtgatagtgaatacatctcactaaatctgatggttttataaagggcagtttccctgcacgtgctctcttgcctgctgccatggaagacatacctttttgctccttgccttccaccatgattctgaggcctctccagccttgtggaactgtgagtacattaaacctctttttctttataaattacccagtttccagtatttcttcatagcagtatgaaaagtaactaatacactacccgagacatcttaggagatttgtaatagctgtaatgccaggtccaccatatttttagcataaagcaaatgtttacgcgtgatatgactgcacgggctttctttcagctggagccatagcaactcaagtagtaaccctatcttagtctgattaaaagtaaatattagtctgggcatggtgggacatgcctgtaatcccagtactttgggaggctgagacagaaggattgcttgagcccaggagtttgagaccagcctgggcaacatggaaaaacaccatctctacaaaaaatacaaaaattagctgagcgtggtggcacacacctgtagtcccagcaccttgggagggtgaggcaggaggatctcttgaacccgggaggtggaagccgcagtgggcaatgatcatgtcagaggtgtgtgaaccagagcaactccatcttaaataggagccaggaaaaatgaggctgaaactactgggctgcattccctgatggttaaggcattctaagtcacaggatgacatagaaggtcagcacaaaataccagtcataaagaccttgctgataaaacaggttgcagtgaaggagctggccaaaacccaccaaaaccaaaatagagacaagactgacctcccatcatcctccctgctacactcctaccagcaccatgacagtttacaaatgccacggcaacatcaagaagttaccctatatggtctaaaaagaggaggcatgaaaaatccactccttgtttagcatatcatcaagaaataaccataaaaatgggcaaccagcagccctcacggctgctccgtctatggggtagccattcttttattcctttactttctctctttttttttgagatggagtctccctctgtcacccaggctggagtgcagtggcgcgatctcggcttactgcaagcttcgcctcccgggttcatcccattctcctgcctcagcctccagagtaggtgggactacaggcaccggccaccacacttggctaatttttttgtatttttagtagagatgaggtttcaccgtgttaaccaggatggtcttgatctcctgacctcgtgatccacctgtctcggcctcccaaagtgctgcgattacaggagtgagccacggtgcccctcctcctttactttcttaataaacttgctttcacttcacactgtggcatcaccctgaattctttcttgcacaagatccaagaaccctctcttggggtctagattgggacccctttcctgtaactatcatgctactgcactccagcctgggcaacagagcaaggccctgtctcaaaaaaaaaaaaaaaaaaggaacatgacttaatacattcattttggaggataagtctctcaaaataggcctttcactgggggaaaatggtaaaaatactccctggtaattcaagaattggagactcctgagatgctgctcatattagctgagcacttatcaatacttcacttttttccatatatactcaaggaacaagtgctatttaaagtgtttcactccactgggctaggtgcaagactataaagaggtgtgaggatcaacacttttatgaaaaccagtgtcattctggatatagtttcagatgctagtgcaaaggaagctcttggtatacggaaaaagtattcaacaataaattaggcatggttgcttccattttctgcctcacatactttttttttcgtggttaaagtgatataatgtctatgatattttagattggcagttgcaaactagtggtcctcagcgtgctttttatgacacctacaaggtctgaagactttgatttcatattaaaaatctgggtttcaggctgggtgtggtgttgcatgcctgtaatcccagcactttgggaggctgaggcaggagaatcgcttgaaccagggaggtggaggttgcagtgagccaagatcgcgccactgcactcaagcttaggcaatagagcaagactccatctcaaaaaatgaataaataaataaataaaatctgggtttcaggccaggtgtggtggtgcactcctgcaatcccagcactttgggaggctgagatgggcagacagcttgacctcaggaattccagactagcctgggcaacatggcgaaaccccatgtctacaaataatacaaaaaaattagctgggtgtagtggagtgtgcctgtaatcccagcaacgtgggaggctgaagtgagaggattgcttgagcctgggaggttgatgttacagtgagctgagatcgccctcctacactccaacctgggcaacagagccagaccttgtcttaaaaaaaaaaaaaaaaaaaaaaattctgggtttctggcatctcaaaaaaaaaaaaaaaaaaaaaaaaaggaaaggtcagggcacatggctgctacagtcctctattaagcaatgtgccacagcagggtccctgacccctgggccatggacatgtactggtctgtggcctgttaggaactgggccacagagcaggaggtgaatggtgggtaacaattgaagcttcgtctgtatttctggctgctccccattgcttgcattgctgcctgagctctgcctcctgtcagatcagcagcatcattagattcttacaggagcatgaaccctgttgtgaattgcacacacgagggatccaggttgcatattccttatgagaatctaattcctgatgatttgtggtggaacagtttcatcccaagaccattaccatcctgcgccccatcccttgccgcctgtggaaaaattgtcttccacaaagccggtccctggtgccaaaaatgttggggactgctgtgctttagaatctgccatgaatctgcagcctctattatatagctccctatagactttgcttcctaccgtcttacgttctgccttataggcatttgactttgcaacccttgtttttgttagtatgctacgctggtgacattgaccaaattgaccacacattaattataagcttagttggtgatgacctcaacggaataacgtgacataagtattgtgacaatacttcttgcatgtatctgcaggtggaattgtaaacctggtggtccgagatggtctaattccatcttcctatgtatctccttatattaatagtggtaacatttgtggtggtgattcagcatttcaatgcctcttctcatggcaacaacaaacgttttccttctgaatcaacattaacctagatgttactgcggatcaaaattagactctacattttcaaccacagaaataccgagcagtaaaaatttttcttaatattgattgcctacataggttgtgtaattagcatatgtttacagttctatgatttctgcgtggctgctacagagctggagggggtaaagcaacagtattttctcagttgtccgagcagcattacattataataaataggtaatattaaactgggctgatgagagttgcaaaagactactttaatgttcatatggaaccaaaaaagagcccacattgccaagacaatcctaagcccaatgaacaaagctggaggcatcatgctacctgacttcaaactatactacaaggctacagtaaccaaaacagcctggtactgctaccgaaacagacatatagaccaatggaacagaacagagccctcagaaataataccacacatctacaaccatctgatctttgacaaacctgacaaaaacaagaaatgcagaaaggattccctacttaataaatagtgctgggaaaactggctagccctatgtagaaagctgaaactggatcccttccttacaccttatacaaaaattaattcaagatggattaaagacttaaatgttagacctaaagccataaaaaccctagaagaaaacctaggcaataccattcaggacatagggatgggcaaggacttcatgtctaaaacaccaaaagcaatggcaacagaagccaaaactgacaaatgggatctaattaaactaaagagcttctgcacagcaaaagaaactaggatcagtgtgaacaggcaacctagagaatgggagaaaatttttgccatctacttatctgacaaaaggctaatatccagaatctacaaagaacaccaacaaatttacaagaaaaaaaaacaaaccccatcaaaaagtgggcaaagcatatgaacagacacttctcaaaagaagacatttatgcagccaacagacacatgaaaaaatgctcatcatcactggccatcagagaaatgcaaatcaaaaccgcaatgagatatcatctcacaccagttagaatggcgatcattaaaaagtcaggaaacaacaggtgctggagaggatgtggagaaataggaacacttttacactgttggtaggactgtaaactggttcaaccattgtggaagacagtgtggcgattcctcagggatctagaactagaaataccatttgacccagccatcccattactggatacatacccaaaggattataaatcatgctgctataaagacacatgcacacatatgtttatcgcggcaatattcacgatagtgaagacttggaaccaacacaaatgtccatcaatgatagactggattaagaaaatgtggcacagatacaccatggagtactatgcagccataaaaaaggatgagttcatgtcctttgtagagacatggatgaagctggaaacgatcactctcagcaaactatcacaaggacaaaaaaccaaacaccgcatgttctcactcacagatgcgaattgaacaatgagaacacttggacacaggaaggggaacatcacacactggggcctcttgtgtggtgggggagggggaagggatagcagtaggagatacacctaatgtaaatgacgagttaatgggtgcagtacaccaacatggcacatgtatacatatgtaacaaacctgcacattgtgtacatgtaccctataacttaaagtataattttaaaaaataagtaaataaataaataaaaaaagaaacaattgctggctttgcaattctctttcctccaaaatcgccaaggcctcaatttactcattgctgaaaaaggacgactctgtatatttttaaatgaagagtgttgtttttacctaaatcaatctggcctggtatatgacaacataaaaaaactcaaggatagagtccaaaaacttgccaaccaagcaaataattatgctgaacccccttgggcactctcttaattggatgtcctgggtcctcccaattcttagtcctttaatacctgtttttctccttctcttattcggactgtgtgtcttctgtttagtttctcaattcatacaaaaccgtattcaggccatcaccaataattctatatgacaaatgctccttctaacaaccccacagtatcagcccttaccccaaaatctttcttcagttgaatctctcccactgtaggttcccaggccgcccctaatcccgctcgaagcagccctgagaaacatcgcccattatctctccatatcacccccacaaattttcgccaccccaacactttaccactattttgttttatttttcttattaacataagaagacaggaatgtcaggcctctgagtccaagctaagccatcatatcccagtgacctgcacgtatacatccagatggcctgaagcaactgaagatccacagaagtgaaaacagccttaactgaagacattccaccattgtcatttgtttctgccccaccctaactgatcaatgtactttgtaatctgccccactcttaagaaggttctttatcatctcccccacccttaagaagtttctttgtaattctcctcacccttgacaatgtactttatgagatccacctcctgcccccaaaacactgctcttaactccaccgcctatccccaaacctataagaaccagtgataatcacaccaccctttgctgactccttttttggactcagcccgcctgcacccaggtgaaataaacagccatgttgctcacacaaagcatgtttggtggtctcttcacacagacacgtgagacaggagttcgagaccagcctggccaatctggtgaaactctatgtctctactaaaaatacaaaaattagctgggcatggtggcgggcacctgtaatcccagctactcgggaagctgaggcacaaaaattgcttgaacccaggaggcagagtttgcagtgagccaagatcacactgtcaggcctctgagcccaagccaagccattgcatcccctgtgacttgcacgtatacatccagatggcctgaagtaactgaagatccacacaagaagtaaaaatagccttaactgatgacattccaccattgtgatttgtttctgccccaccctaactgttcaatgtactttgtaatctcccccacccttaagaaggtactttgtaatctccccaacccttaagaaggttctttgtaattctccccacccttgagaatgtactttgtgagatccacccctgcctgcaaacatggctcttcaccccctatcccaaaacctgtaagaactaatgataatccaccaccctttgctgactctcttttcggactcagcccgcctgcacccaggtgaaataaacagccatgttgctcacacaaagcctgtttagtggtctcttcacacggacgcgcatgaaacacacgaccgcacttcaggctgggcgacagagctagattccatctcaaaaaaaataaaacaaaaaggagtcacctcccccgagaggcctctggaccaccccatctgagcaggccactcttccttctctatcttaccatcttgtttctgtcccagtagttagggctacctccagtaatcctatttgtccctttactgtttagtgcgtctcgcttgactagaagctccatgaaagcaagagaccctacctgcctccttcgccactagacccccagggcctggtatgtggtgatcgctcagggcccattttcttcctttcctcctcctccaagggtggggaaagagcatcagaaggtctaggtggccccaggcccaaacaatgctcctttaaaaggaaaccagattgttacaaaggtcagaggctgaaaagttatttccgccttttatccctctaaattcttcacttcctgaaaaaacaaacaaacaaaaaagccactgagggcccttggactaaatccaggcctcagttgctgggcagaggtcagtcttgtccagacatgggaaaaaaataattcgagtcagacaggtgggtcaccagagaacgaatccagcctgcaaatggcctgtgcaatcttcagctctgtccagacctgcctccctttggggatgcctttaaaggtgatgaatgatctggatgaatgggcttagaagataagagggaaaaacaaatatcacaggtcaaatcgttatttgtcttcaagtttaacaccgtctactggactaaaagatgtccaaagaatagttgttcaactatgtaaattcctttttttctttttttttttttttgagacagagtctcgctctgttgcccaggctggagtgcaatggtatgatcttggctcactgcaagcaacctctgattttagtattgttagtacagacagggtttcaccatgttgaccaggctggtctcgaactcctgacctcaggtgatccacctgcctcggcatcccagagtgctgggattacaggcgtgagccaccgtgcccggccaactacataaattcctaacaacgtatctccagaaagtataggcacaacagcacatgcagtcattcctgtaattaagtgctccgggaggccaaggcaagaagatcccttgagcccaggagtttgagaccagcctggacaacatagcaagactgtgtctctacaaaatatacaaaaattgggctggggatggtggctcacgcctgtaggcccagcactttgggagaccaaggcaggaagatcgactgaactcaggagctcgggaccagcctggacaacataacgagacccagtctctactgaaactcaagaaaattagccagacgtggttgcatgtgcctgtagtcccagcactttgggaggccaaggtgggtggatcacctgaggtcaggaggtcgagaccagcctggccaacatggtgaagtctcgtccctactaaaaatacaaaaattagccaggcacggtggcacacacctgtagtcccagctacttgggaggctgaggcaggagaatggattgaacccaggaggcagaggttgcagtgagccgagatggcaccattgcactccagcctgggcaacagaacaagactccatcaaaaaaaaaaaaaaaaaaaaaaaaaaagaaagaaagaaagaagaaaagaaaattagccaggtgtggttgcatgcacctgtagtcccagcactttgggaggccaaggcaggaggatcaatcaaggctaggagattgagactgcagaaggaaaccctgtctctaaaaacaaggtccagctaaaatcagggtccagctccaccacaagcgcagctccaggggctgttgagttttgcctctaccattccaagtagtctctgctccagaccaagtcccaccatctggcagtcatgtcagtctaaccacagtcatatcagggcgcttccagtcattgagtgccccttgaggaggctggaggagaggccaatgacatttgcacttgagactccagagtctagatttataaccactatgttatggctgccagtgtggctgcaaggacacttctttcattcattcatttacaatagatgtagcatctgctgtgtgccagatgccattctaggttatagggaaacaaggcagagcccctgttttccaaggcatccacattctaggaaagactgctaccagcctggcgtggtggctcatgcctgtaatcccagtactttttgggaggccgaggtgggcggatcacttgatgtcaggagttcaagaccagccaacatagtgaaaccccgtttctactaaaagtacaaaaatcagctgggcatggtggcacgtgcctgtagtcccagctactcaggaagctaaggcaggagaattgcttgaacctgggaggcagaggttctggtgagccgagatcatgctactgcactccagcctgggcaacagagtgagactccataaaaaaaaaataataataataaaataaagactgctactaaacaataaaataaccaaaccagatagatgacttcaggtggtggtaagagctttgaaagaataagcaaggtaactaactggtcagaggaagggagatgggtgcattccctcagatagaccgccccagaggtctgcctctctgacatgacatttgagcagagacccaacaggaaaaggaagagactgctctatggccaggcacggtggctcacacctgtaatcccagcactttgggaggcccaggcgggcggatcacgaggtcaggaaatcgagcccatcctggctaagacggtgaaaccctgtctctactaaaaatacaaaaaaattagccgggcgtggtggcggatgcctgtagtcccagctactcggaaggctgaggcaggagaatggcatgaacctgggagatggagcttgcagtgagccgagatcgcgccactgcacttcagcctgggcgacagagtgagactccatctcaaaggaaaaaaaaaaaaagaaccaagaggtgtccaggcgaagagaacagcagatgcaaaggccctgtggcagaaacaatcttggtatgctggaggaataggaaggcagccagtgcagctggagcaggataggttaagggaggatcaaggtgatgagggcctggaaagaggggctggggtcgaatcaccagatcctgttggttgcaatggaagagcctggagtttattctcagagcagtgagaagccactggaaagttgtttttttgtttttctgtttttgagacagagtctagctctgtcacccaggcagactgcagtggtgcaatcttggctcactgtaacctctgcctcccaggttcaagcgattctcctgcctcaggctccccagtagctgggattacaggcacatgccaccacacccatctaatttttctttttcttttttttttttttttttgagacagagtctctgtcacccaggctggagtgcagtggcgcaatctcagctcactgcaacctccacctccctggttcaagcgattctcctgcctcagcctcccgagtagctgggactacaggtgcatgccaccatacctgggttaattttttgtgtttttagtagagacaagatttcaccacgttagccaggatggtctcgatttcctgacctcgtgatctgcccaccatggcctcccaaagtgctgggattacaggcgtgagccaccgtgcctggccagccaccggaaagttttatgtaagcaggggagtgatctgttttatcatttagaaggatacacacctcttcttctttttttagagacagggtctagttctgtcacccaggctggagcccagtggcacaatcatagcttactgtaacctcaaactcctgggctcaagtgatcctcctgcctcagcatcccaaagtgctggattacaggcatgagtcaccatgcctggtcacacttctcattctttaaaccagacctcatttgtccatctcccccatcccccgccccaccccacggactgtcctataatgcccatacaacaggtcactgtttagaaagtgctacaaagttacaaacacagtcccttctgagcctcccaccaatgttggtgggtacaaggtcaaaaaaaaaaaatctcatctatctaaggggcataggagactttttagttagagggcccaattatagtcctcctgaaaagatgccaaaagtccccttcaacacttagcaaagattcaagaaagatgaatctcacattctttgtatgggaaatgaggaacttgacatcttcaatataatggattccactaaaataagatgacgatcaataggaaccaactaaaaaaatacttgactagctgttattgaaaggctgaaattcagctgacataagcagtattaatattgagctagaaaataattcgcattgaattcagcccaacttttgttttctgatttgggtctcttctaaattttttttttcttctggacattgggaacaatccaatttgaaggcctcaatgcccaaatctacactcttgttttattctatatccttggtttcttttttttttttttgagatggagtctcattctgtcgcccaggctggagtgcagtggcgtgatcttggctcaatgcaagatccgcctcccgggttcatgccattctcctgctgcagcctcccgagtaattgggactacagatgcccgcccccacgcccggctaatttttttgtatttttagtagagacggggtttctccgtgttatccaggatggtctcgatctcctgacctcgtgatccacctgcctcagcatctcaaagtgctgggattacaggcgttagccaccgtgcccggcccacacctaggtgatttttaaagttcttctagtagagacagggtctcactatgtcgggtcgccgtgtttgatgtcagttttccctgccagaatctacaatctccttgatcaccattatatcccaacgtagagctcagtacctggtacaaagcacatttgatcaatacttgctgaataaagaaataaaaatgaagaggcactccagcctgggcaacagagtgagatggtctcaaaaaaacaaaaacaaaaacaaaaaacgactggaaaggagatgagggtacttgtgaagccatattatatgacacgctctgtgctaggacttttatataccttgtctcatctcttcatctcatataatccttacaaggatctcaaaagtggggaaatccccatataactgaagacgaaggcagttcagaagttcactgatttgccctaaggttcctcaatttgcaaacgtcaggccaatgatccaaccccaggtatgtttggcagtgaaggaccagttgagtcacagctgcaagtaaccaccctgcagtggtccctatcttggccgttagcttacattgacatttaacactcaaatttactcagtaacaccagctatcatgttttccactaaaactccacagcattctggcaacttttctattttagagcaataaagtaaattgttagcatccctttgacatataaatatttctacaaatagtaattctctagccattcatttggagtatttaaaactcaacattcatagcacattttatgtgacaaagaacttctgttcagaacacaaaaataagtcgtacatcttcattaaaaacgggtgaagaatttgaacaaacatttgcaaactaaaatacaaatgaaatacactcaacatcattagtcatcaagaaaataaaattatgagataatcactaataatcactacatatgcaccacagtgattaaaatttttttaagttaagccacgtgacccaacaaggtgcattcactcaagagaaacgcaaatatatgtccactcaaagacttgcacatgaatgttgagagcaggtttatactgaatagcgcaatgtgaaaaaaccccaaaatctagcaaaggatgaagggagaaataaactgtggtatatacatacaatagaacactactcaataataaaaaggattatattcctgatacatgcaatatgggtgaaccgtaaaaatatcatgctgagcaagagaagccaaacacaagagaacatgttgttatgatttcacgtacatgaaactttagtaaagacaagtctaatccatagtgacagaaagcaaatcagtaactgctgacaggggcaaatgaggagatgatctcaagggaaccttctggggtaagatgctgttctgtatctcgatcgtattggtggtcacacaagtgaagacatgttagaactcatcaaaccatacacttagaatgtgtaatataaacctcaataaagcaaaattaaaaaaaaaaaaccacctttaattttctcttacaaaaaaaaaaaaaaggaaaaccacttaactttaattttctccaacaactgattctggtacacagtataccttaatgcctgcatccacggcctcacgtcatgctgtttacatgaacgtaaagcttcgccgaagagtggaataagacagtcctgccagagaaaaaccaaaattactcaacgtaaaacaggctgttgatatgtttgcagatatatagcaagtcttaagtccaagactgcaatatagtttggctacttcagattgattgcagtagttttatctattacactatacccttccatcatttatcttctactcacaagaggcaagcacacagtaagagaaagccttttgttttgaagggaaatcttcttcagaatattaagtctaatttatcaatatacttaataaagcacattacaaaaaaaatgtcacagcacatttactataaagcagactgcagaaaaacattacaactaatgctttattatgaagttctcgaagatcaccattcattcagaagcccccatctctggtcgaactttaccccatttaggatgaagaggagagatctttgtttgcagcaaatctaaaatttacgtaatccgcctaaaggaactgtctttacatacaccacctcccaccccaaaaatagaagaaaaaactgagcaatttgccatccttgcgattatctcaggttcttccatctgccccatgtacttcccaaatgaaagactgcctgaaaacggcatgttagatttctggatttaccagcttgcccaactacaaatcctattccaaaaaactcaaaaaataaggtctttgttctacagtaatgaccattaatagtcataagagtgtgcttgtaaaaatatacagacctctgttgaaagtctgttagaaactgtggtctccaaagcaaacgagcaatacagctacaaggtacttagaactggcaaagactgtgaaactgttaaagtagaaagtctcagaggtccaatagtgatgcgggatgtttgcttcaagtactttaccacatttctgaaacaaaatatttactgtcaattaataaaaattacaattcataaccactcaaagaataaagcaattgataagatgctatcaaactgacatccaaagttagggggcagtaagaggagcagcctgctctataataaaatgatatcagcaagtcaagacatttgcttttggggatttttacattttatttcatttcaacctcagtttttgttggcaagcagcattcatatatcatatgacttctacaactaaaatgaagctattagcactagtatttagtaatctagtaactctccttccagccctcttcaccccatgtatgtttatcacatgatatacacaatgtacatttacctccgtaagagtaaacttactcagttatagactgccacttctgatcttgttctatcgggtttaaagcagttgccaaacaaacagaacttcttaacaatggaacttcaatggatttctgaggttcccttggatctggacttcacatgttacgaagcagttttttcatgtctacagaagttaaatgaaatgtcattaagttaatgtgcttttattataaattttgatttatgtttggcattattaagaactaatcaccaatgaacagctcctttaatatttcaggcagttaaacactataagcattactgagagctatataaaaatcatacttcatacaaaattactgtacctcagacccctaaaaagcagttgccttcaaaggctcaaaaatcactaagtcgaggtcaggtgtggtggctcacgcctgtaatcccagcactttgggaggccaaggtgggtggatcacgaagtcaggagttcaagaccagcctggccacgatgatgaaaccccgtctctactaaaaatacaaaaaattagctgggcacggtggcagacacctgtaatcccagctactcagggggccgaggcaggagaatcacttgaactcagagggcggaggttgcagtgagccgaaatcgcgccactgcactccagcctgggcaacagagtgagactctgtctcaacaaaaaagaaaatcggtaagtcaatctactatttaaggggacaaatctagacctgcattagcaagtcttgctcaatccagaatactcattaaactttttaataacatcttatcaagtgttccatttgtgataaagaacttaatgagccacatcaagatgaaaatcaagaaaaatatttagctgaaacactactttgtcctttatcaaacaaaatggctagataaatctcaaagtattaaggtggtcattttttttatttgacttaattttaagtgcttttcatttcccaaatcaaacataaatagggcagccctaaatttgttgcttcacatgggattctgcccccacaaaaatgtaaaataacttccagattttccagtaaaatatactaagccaaacattttgagcaacttgtccactaaaataactttaaaactattttctcaaatacctacctattttttcttttgaccctccagcaagtagattgatattttctcctggtaacaattctaattgctcggtacatttgacaaattttccagactcaaagctgcttaatgatctgtaattaaaatattgcttagcttgtattcctatgcagcctgtggaaccattaaaaaaaacaaacaaacaaaaacagaacaaatcctaggaagacagcaaagtacacagcatttttctgacaaaattccttccacgaggatgccattattttggtttttatgttgaagatgtgactaccacttaattagtactcaaattggagtggcaaaccagaaagtcacagctacagactttcagtggagctgactcgcccctgtgtctccttcctgttttcatgtgttgcagcctgttctcttcagagcctgacacactgacagtagacctctgcaggacaactttgacacccagttctctccaagctgccagtgagctccctgtgcagcctcactcctcacctacagcatgagcccttgcagctctcccagcatcacaatcttgtatctcagtcctggcttctttcactgctggcatccctctgtctctccctttttcacctacttttcttttttcaaagaattcttctctttcatctgcttatatgaaaaataatgacacctctgaaattctttcctgtagttctgcagcatcaatgccaggaagacaggcctcatcctcccagcttctatgctgctcctttcagatcccttaccctgtccccattttcatgacacgggctctccagccaggaagaagacactgtttctcactctctcttttccatctttgcctgtccctctcgctgtgtaacttcccttataactcagcctgaggccagtgctagaaaggcacatcacctgacttattctgtgcctgattctacctagatcagtgcaaccactggcttctcagggggacccttgagtactgggcactgatgaactgctgccaacacagtcatcatttctgccattaaaaggtcctaagtcctctccagtggcaggttccccaagtccccactatgctctataatgccctatgctttcagctaatgactcagtcctcagaaaaaacaaacaaataaacaaaaaaacacaggctttaatttcctctacccctacccccaatccaccatacactgccgaaattctgtctataccaactttgactgctttccttgaggcagagaaaaggtgagggccagttaatctatcaatgttctttctcctgtttcttcaacctctgctttctagtggctccttccccttggccaaaagaacataatctctccaacatttaaaataaacatctcatatttccctccagcaacagcttcctatcctcgacttcaagaaaaactcactgaccaaataacttacctcaagcttttcattttcaaatgtctctaccactcaatactattcaatctagcttcttctgtctctctacaaaactctttttccttataatccctagagcatctgacaaggctgactactcccatctggatgtcctatatctagggcacttcccttctcaatgtccctgttatttttttgaatggcttcctcttctatcctttcacaaaaatgctaaactaggattctgacccaggccttccttcctcttcactcactattctccagaggcttctctctggtttggttgcttacaaaggctctagagtatagagactgaaaaggaaagagggccttttctgtgtactaatcatctgcaaatctctcaagcttagactgtctccttagttcaaaatccaattcttaacagcttacccaacaatctcatctgcacatttcattagaaatcttaaaacatggcttgttctctgtgtgctcctactccagttaatagcattgtttctcttccctctaccattgcccccataaattaatggtctccatgcttccatacttgccccgcacctccagtctcttcaccacagcagaatgaaccaagtcagatcacaacacatctctgttcaaatcccacctgaaattttcagtcttactagaataacagccaaagttcttctcagttcccagctacttctctgcccttatatcctactgtttaaggcgctcctaaacacacaggcctcccagctatttccagaacactccaagcccatcattctcacatcaggtctaggcccaaagggcatcctgatgggcatgtcttgaccttgtgtcttccctccaaagaaggtcagctttacctaactgctttccttatggcacagaaaaggtgagtgaggtccaattagtccttctatcaataatctttatctaatctttgctttaaaaggttggaatttgtgtctgttttatgtgctgcctgggtcacagcacatgctcagtgaagcaattacacattaacccatttagcagtagaagtatcagacaaagtctaatgacctttatcttcccagccaagtgtctgcaacagagtgctcagttttgaattacagaattaataaaagcacagaggaatgagaagaaagtttaatttacagatgttcacaaactctgtcctcattagaataaatgtttttgatatattcagacctcatttagaaacaaagccatcaaatgtgattctttctaaagcagtacaaatttttctttatattcactctggcataatcttcaaactgtattaaggttttagaacaacaggttctgaaaattaataccaaatgactatctcagcagtgttttcccattatacaaataccttccctcatctctgatgtcagtttcctgttgtcattttcataatggcagtaagttagaaatataaccattttgtattactacatatgaccaattttaatatttttttgccataggaaaaacatcgtagttattggaaatttgttttataactggaaacagaaagccttactttatatagttgaagtcagctttcaggttgaaggaagtgctactggtactctttttcaagtcatggatagcgttctgccattcctgcacagcagcccaatcggcaattgagatgtagcactcacatgctttatttcctaaataatttataacctcaggggaagagtcagtcggtttggacagcacagtttttctggattcacctgaaagtattttataaagtaagaagagagagattcagatcaattagaaatatttcaaagagcacagaaacctaaaaacatgataagatcatcagtacgaaatatattactataacttttgctttatttaaaaatactgaacgctcaccattcagacaatgtttcgggctggcactgttacacccagcattggctaaggtgagcaccgatttgtcaaagctggagatgcagcaatgaacacctatcatggcacacaggtgttcctggtactccacagaggccttttcaaacctgaaaagcaaattgaagcagtcttatttctttatttatctacttacttactttttttttttttttgagatgaagttttgctcttcttgcccaggctggagtgcaatggcactgtctcagctcaatgcaacctctgcctcctgggtacaagcgattctcctgcctcagcctcctgagtagctgggattacaggcgctcgccaccatgcccggctaattttcttgtatttttagtagagacggggtttcaccatgttggccaggctggtcttgaactcctgacctcaggtgatccgcctgcctcggcctcccgaagtgctgggattacaggcatgagccaccgcgcctggcctttacttacttacttacttgttttttgagacagtcttactgtcacccaggctggagggcagtggcatgatcatggctcgctgcagccttgccctcccaggctcatgcaatcctccaacctcagcctcccaagtagctgggactacaggcgcccaccaccacacctggctaaaacaaggttttgctctgttggccagggtggtctcaaactcctggactcaagcgatccgctcacctcagtctccccaagtactgggatttcaggcgtgagccaccgcgcccagccccaaaggaggctgttattttaaacacacatatctcatttcccccctcccacaaaaaatggtgcaagaataaactgagctaaaacagtgagttgactatggtggggggaggtttgatgtcttcctcacaactatgaaactaaatttaaaagtggttaaatgttttttaaaaaatgtaagagtataaaagaactagtggaaaatattgataagtaactgatgtcagtgtgtggaaaggctttgtagaaggataaaatgcaagaaaagatgcacaagtaacagcatctagatgcataatgctgaaatacaacactaaacattaaaaacaaattataatcaagaaattggatagcatcaacaatcttagtatttaatgaaatttcacagattaacacaggaaaaattgagaggccatgaagacatgatccatgttttaaaaaatcacaaatggtcactatatggggcaacttctactattagtcattaatacatatagaaatgtaaagtacaataactattttcgctgatggtggtggcagcattcttgtttctcagtgactctcagtatccacaaaggtgaagggaagggggtactctattattaagggtatacattgcagccatcttttctgtagagtaacttagcaatagaatatatcataagacttatggtttggcagcctttcttctagtaaatcagtttatgagaatggattccaagaaagtaatcagaaatataagcaaagatattaagtgctatggtacatttagtaaaaaaaaaaaaatcagaaacaaccttaatgcccaacagtaagaaatattaaattatggtacactcataaatacaaatctttattaaaaataacactgtagaatacttaacatggcaattttttttttttttttttttgagacagagttttgcttttgttgcccaggctggagggcagtggcacaacctgggctcacagcaacctccgcctcccgggttcaaccgattctcctgcctcagcctcccaagtagctgggattacaggcatgtgccaccacaccccactaatattttttgtatttttagtagagacggggtttcaccatgttaggctagtctcaaactcctgacctcaggtgatccacctgcctcggcctcccaaagtgctgggaatacagatgtaagacaccgaacccagcctacctaacatggcaaattttttttttaaatattgagtgggaaaaacagatcataaaaccatgtgcctatgtatgctgctgttttggtgaagaatggagaaaacgacatgaaagaaaaaagaattacaaagcatatggatatggaaatatgggactacaaaaggacacacaacagaagttactacaaagatatggaagaatgagcagttcttttattttcctaaattcgcaagatttcattaaactaacataaatggacacagaatattatggtacaagctcctctatctggaggaagcaatgagtctgaatgtagagttcacaggactaatgagcaaatactctgacaataaagggtaatttgtatcagactctgagggggaaggagctcaactagggatcaagttcaaaagcatttataaaacaactgacaggtcttgtttttcagtgtgatttgccactaattcttaaataagaaaggcactcaagtattgctgctaactaaagaacaaactgaagatgcctcctggtgaagtgatttatagcaagcttcaatgctgaaagcaaacaaagctgttttaagatttggctacaatgtcagtgagtaatacaaagaatttaaacataaagtaattctatcacccatttccttccctccaacctacctcccttcagcctgttgagccactgagttaatccacagaagattttttccaacaatagatgatgaccagacagcaattccctgtatagcttcaggacaatgaagttcacatagtgcttctaccaccatcataatggttacttccaattcattcccctgaaaacgcattcagaaaagttagtcacccaataccattaaaacataaatccctataaaatttacaactgatcacagtctgtgcctgcttaaagccaaatgtatttaacaattattttcacaattttcacattatttagctcagaattctttaaaatgttacatataaaatagccacaaagggtgactaacagaaccttagcagcacatggatgtttgcacccccaccccaaagttacccaaacatttaacctgtgacctctgtaggaataacacatggagtaaaaagaaagcaaaaattaaatataaataaacaggaattaaagaatgattaacttcatgtgtttgaatactgcttgacattacctgaattgctaaacattttgttatttttggattccagttatttattgtgagcccactttcaagccaggaattactcaagcatttgtcatacgttataaaaacaatttctcctggccaggtgcagtggctcatgcctgtaatcccagcactttggaaggccaaggtgggcggatcacttgtggtcaggagttcgagaccagcctggccaacatggtgaaaccctgtctctactaaaaatacaaaacttagctgggtatggtggtgggtgcctgtaatcccagggactgaggcaagaagaggcttgaacccgagaggcggagcttacagtgagccgagatcacacaactgcactccagcctgggcgacagagtgctgtgtctcaaaaaaataaataaataaataaaaaatttcccccataaacaaattttcagaattacctttaaagttctaaactttgcacataagaaatatagttttaacatgttctaagatgaatattgttttaacatgaacaaaaacatgaacattattttaacttctaacactgttttaacacgaataaaataggtaactctggcagttgttgcttttacaaaatacaggatcaaaacctttgaaaatgaatccaagctttaacttattttatccatagattaaatcataccaaaggaattaaaccatgtttttcttattaacagacttaaaatgaatttcaaacacaccactttacctgagataggctggttgttttcatctctgtaagcaagtcaaagccatgtctcactgtcactgcaggctggcctgccaacaatcctaccctcatgatggagagtcgaatccgcgttagccagtcctgacaagtttggcgattggtatagaaaaaagttctagtcactttacgataagagaaagaaaagctcaggactggttcaatttgtaggtaaggatgtctcacctatatataaaccaaatacacaagtctattgtgatttcagctctgcacatactgccagctgtgaccattaaactgctataaaacaacactatctcatggaaaccaaccttgggaggtgaagttaatgcattagcacatccctcgtatgcattatacattaatttctccagatattccagatactgcagaagaagaacaagtctaagttggttgttaccatggccttcatcactgtctgcagttgtccactgactaacatcctgatcagggtttaatgtgtgagctgcgagacttcgaatgatacctgaaagcaaagacaacattctgaatttttaaaaatcttaaaagttcctagaataagtgtgagttttttatgatcaattcacatttatcaagtatcctctgtctacccatcatttaaaaataaaaaatcccaacatgaaagatctttcattttaggggaaaaaaatatatattttttccacacaactcccataagttttgggaaaaaaacaaacatatttccaatgcaattattcaatgaaagcttattctaacaaacatacctgaaaattactgacttcttttcaaaaaaatcatatactctcaaatctttaacaaagatttaaaaatccattatttcttaataaggctttgaaagtattcacatcacaaagcttgagcgagttaccttcaattgtctggaaggtgtcttgagctctgcccagtggggttctcagcttagaaagaacagtgaattgtgcagcttcccatacggcccactgccaaaggatagcatctgtcttcaggagattgcgtggaattgttgactggtcatgcttatccagtctctggcagctatagaacagtctttccaaccaattgtccttcctgggaaaagtagtttcatatttaaaagacaatgacaacttcattttaataatgaaaaaaaaatgcaaggggaatgggaataaggaactgtaattttccctactccaaaaaaaggcaaaacctatgaaattgagaagcattatgtcccccccctcttattttgaggtcttttatagttaacaggatgaggtacagcgtggaaggatgattagggtaaacggctcatgccggtcaggaatgaaactcattcaatgcaactaagcatctctagaatatctccacccccaccccattccccaaagtgttaatgacatcacatcagttaactgttaaccacatttcattactcaatttcaaagcccatttttgtttctacagatgctatcttcaaagtaattttcctattgatgaaaactgaaataacccatatgagaagaatgttacttgatactctgccacccccaaacatattttctcttcaaaactgcatgtaaagtaaagggaatcttaaaattatctttcctagataaaatagtcaaagaaatgccttaccctgttctatgagagttcccatacaaaataaaactaataacatcagagaaatcttgggggtggaatgtattacttggtgctttactcatgtgacttcttaatgctaaagaaatttcttgaatttctgtgtgattgttattgctgtagacagaaaataaagttgttgttacgcaaaatattttagcttaaaaggttagcacatactgtaagtggattatttacttattaactcactggaggtaaaaatatagaaaaattgagactttcaaatggatacggagatgtgattacaactttagatcctttttttattcacttcagatgggtcatgtgccgacatcataagaggatttgagggaggcatatcaaacatgtgaacataaaaacccaatcattatgcttatgtattacaaaaggatcaagtttaggctcttaaaagctcccaaatcaacttgatcaaaaacaataaaagattactgtttagtttttcaaatatctgagctactaagaaacatattttggcactacatgagttattctatactaattattgtgagcctataaagctcattaaaaatttttaattttcttgcagacctgcaaaatttgattatttgacatcacttcaatcactgacaagcagggccataaaagatgtgtcattaatgctctaataggtgatctgtcttctcctaaagtagacaaccagtagaggctgtaaatatcacagaatgtctttgctccaaaacaactgttataccttaggataacatctaaaggaattgatttcaacagttttccaaatgcttgtcgaatacgagttccacagtgcactagttgaacatggcaaacatcaacacatctatgaaagaacgaaatagacaaagcaggtgtgttaacatttcaaagttattaggattaatgtcaaaagacatgatcttaatttcatacctctgtaaaagatcatctggcaaggaagaggacagagcaggtagactgctgcatgcctgcagacagatattcacatcttcaacgagaactattaaacattaaaagacagctactttcagctggccaaaagaaattatatcccagtttgtcataattatctgaatccattcattcattcaacaaagagtgagtgcctactctagactaggcactgttcttgtccagaatcctcattgactgtcatgtttggaaaaatgacacattcaacaaaacccacgtaatgtaactgatgggtcatcacacaaaactttttctgagagaaaatgtaaaagtatatgcaaactataaacattcacgtaagcttaaaaatgtgacaatcacttcaaaacatttttctaatactaagaatgaaaaaaaatcaagactgtgtatctgtcattaaaatgaggattacacatctgcaggtcaggaaaagagctctattgatgaccatctcccattaccaaggattgataaacaaaatagaaaaaaaaaaacagagtcttactgttggctaaaaggcctttgcaaaatttatggaaagacggaagacagaataaaggtgcatatgtttcggacttcttcattaaaacagctacttccaaagcccaagtcattaacagtttcctgaaacacaaaatatacagttgactgtacattaaaaacaataacaaaaacaaaaaaacgttaaaagcctagtcttcttacattggttttctcttggtttttcaaatatctcaaacaataaaaaataaaaataaaaaatgaaactatagaaattactgtcaaaattgttgtgtgccttttaagaaaacctcccaacgcagcatgataatagcaaagaggccgggcgtggtggcttacctgaggtcaggagttcaagaccagcctggccaacaacatggtgaaacaccatctctactaaaaatacaaaaattagctgggtgtggtggcgggcacctgtaatcacggctacttgggaggctgaggcagaagaattgcttgaacctgggaggcagaggttgcagtgagcaaaactccgtctcaaaaacaaaaaaagcatagaatattaaaaatctatatatattcttctatgaaacactgggggtgggggattgaggtttttcatgtatttcttttcagaaagaataagaaagcctagattaaataataaaaccaaattataaggtgtttgacagtaaagaagctgctctacctcacctctataatccacattttttaaaattttttgtaattcacatttcttattctcaaattataaaggcaaattaacaaagttaggaatagttaatactatataaaatctgttacctcgtgtcctggttaaggttatctttcttaagtaatattcacagaagatttaatataattgagaaatgtttctttgtggccgtagttacagtgctaatcacagctccatcaaacaaagaaggagaggaagaactgaggctactagagataaagtgatcatgcctgaaagacaaagcatagattatcttttcatctttaatcaaagaaagcaagcaagtccaaagttaaatcaacatacatctttaaaatctatccattaaaaaaataaaatgttttgtggggttcttaagaaaaatttgtgaatacagtacctggtacaatgagaatacaatgtgtagagcacagcatactgaatggcagggaagtgaacagccaggtcactgtgcacaatcatcagattcttactcagaagtgcaaagacagttggagatagcgcccacatctgatcatgtacaaaacaaagtaagtttatggcttctccaaaataagcacaagcatacagagtttatccttcaaaacaggggtatttggactttttttatttggacatttttaaattaaaattacagattggaagggatctagtacactacaccttggacaaatacttttttgtgaagtcagtaaagcctttgcgtgcaatatagcatctctatgcaatgcagcaactccttgtctatcgctacagtaagaaaacagccacaggtcaggtgttgtggctcacacctgtaatcctagcactttgggaggctaaggtgggcagatcacttgagcccaggagtttgaaaccagcctgggcaacacagcgggaccccatctctactaaaattacaaaaattagctgggcatggtggcgcacacttgtaatcccagctactcgggaggctgaggcaggagaatcgcttgaacctgggaggcagaggttgcagtgacccgagatcataccaatgcactccagcctagatgacaaagttaagactctctctctcaaaacaaaacaccagccacatacgaaacacaggaatgagagtacctgtgttccaagaaaactttcttgagtcggagtctctcgctctgttgcccaggctggagtgcaatggggcgatctcagctcactgcaacctctacctccggggttcaagcaactctccctgcctcagtctcccaagtagctgggactacaggtgcccatcaccacgccctgctaacttttgtatttttttagtagagatagggtttcaccatgttggccaggctggtcttgaactcctgagctcgggtgatttgcccgtctcggtctcccgagggattacaggcgtgaaccactgcgcccagcccaacgagaactttctttacaaaaacaggcactagtgttgcgatggttgtacacttctgtgaatatactaaaaatcagtgaattatacacttaaaataacaaacaaaaaacaggtgctgggctgtatttggcccacggaccatagtttgctgatctctggtctaaacagagccctttgtatgtgccttttgcggaagtagactgtatttcttcaattttccatatactgcaaatggcaaggtgccctgttcaataaggaaacaaaggcacaccctgccactatacaccttttccatccatcttgttcctttacactgccaagacactccattccacctgactgccccagccccacccactttctccttatttctagagtacaggacataaacatctttgaatctgcaaataatgtgaataattttcctcaaaaatcaagctttcatgtttgaagaagagtttattgtgacttcaaacataagctgtaactggtaataagcgaagcagctatggaattatacaaggcaatccaatcaaacaacatggagcacactgaagcgcaaacatcaaattttacctttttcctcctaaaaactttattccctaattacatccattactttctttctttgtttctttctttttttttttttcttttgagacagagtctggttctgtagcccaggctggagtgcggtggtgtgatctcagctcactgcaacctccacttcctgggttcaagcaattctcctacctcagcctccaaagtagctaggattacaggtgtgcaccaccacccctggctaatttttctatttttagtagaggcgaactttcaccatgttggccaggctggtctcaaactcctgaccacaagtgatcagcccgacgtggcctcccagagtgctgggtttacaggtgtcagcaaccgtgcccagcctacacctattattttctattaaaaataatgtttttcaactctgtgtggtccaataggaagaagaaatacacaaaccataaacaataaatacaaatcaagagcagggccacgtcgaattacttaaaaaaaaaaacacacgggctgggcgcggtggctcgtgcctgtaattccagcactttgggaggctgaggcgggtggatcacctgaggtcaggagtttgagaccagcctggccaacatggtgaaaccaagtctctactaaaaatacaaaaattagcccgtcgtagtggcaggtgtctgtaatctcagctactcgggaggctgaggcaggagaattgctggaacccgggaggcagaggtggcagtgagccgagattgcaccactgcactccagcccaggtgacaacagcatgactctgtctccaaaaaaaaaaaaagctttttttttcccccctcctaaaagaaagactacaggttgagtatcccttattcaaaatgcttgggaccagaagtgtttcagactctgtatatgtttggatttgagaatacttgcacatatataaaatgagatatgtgggggacgcgacccaagtctaaacacgaaattcacttatatttcatagacgccttctattcatagcctgaaggtcattttatgcaatattttaaataattttgtgcatacaacagtttggactcatcacatgaggtcgggtgtgggattttccacttggggcatcatactggtgctcaaaaagtttcaaattttggagcattttagatttaggattttcagattaggggtgctcaccagtaagtgttatgaaaatattccaaaatccggctgggcatggtggtgcccacctgtaatcccggcattttgggaggccaaggcaggtggatcacctgaggtcaggagttcacaaccagcctggctaacatggtgaaaacccatctctactaaatacaaaaaaattagccaggcgtggtggcgcatgcctgtaatccgagctacttgggaggctgaaacaggagaatcgcttgtacccgggaggcggaggttgcagcgagccaagattgcgccattgcactccagcctgggcaacaagagtaaaacactatctccaaaaaaaaaaaagtattccaaactccaaaatcaaaaacacttccagtcccaagtatttcagataaggaatattcaacctgtatgaatgttcctagggaaaaaaagacagccaaaatataagaccatgtataagaactaacttcagtagacagaaagaaaaaagtaccaggggaagaaagagaccgcattttaaaacaactatacaaatttgagctgtaagaaacactgacattttctataagcatgctagagcaaatgggagaaattcataagacgttttctagaaaataaaactaatataaaaaaacttatcaagatttgtcaaggaaaaagaagaaacgttaaatataatggcaagaaaacattcctaccaattttatttatccaggcatgtcttaaatatggctgtttgttacatacagtgattctgcagacatgttgacatgacagtgaaatacataaatatgtaatgagaaaaggcttaactgtggataaaacaaagtcattacaattaaagactcgagtttttggcatttccagttgtagtcagggcactgaggtcaaatttaactacaaattttgcattgtctacattgaacacatgattcttaaaagcctcatgttttatttcagaacaggcctcaggaagttgcagactgtgcaggaggttgtttagggcacaagtcatttctcccaatattaacttataggcagtctccaaaacaggaatattcttcaagctgagcattgcttgataaacagcatgggctacagcaacaacctgaaaaacaaaaaattcaaggaagtgataaatggaaaataaatcttctaaaattatatggaaaataaatcactatctgtattagtgctgatgatacaaataaatttaagattgatcaattcactgtccgtagcacttaatattttaatttttaaaaaaccaatcagaaaactgacacagatcagtaagctatttcaaatctattaagttttatcacaaataaagagtactataaatgaaaactgtcaataggaaatttccaaaatggccgtttttttttttttttaaataatcaacatcaaaagacatatgcaaacagcagtttaagactgggtttcttaaatctaccaggaaagtctgtggtggatttgactagggggtggttgaaaagccagtcatttttgtttataaaatatacagtacttaatttataactttataaatgtgtcaacttgttttacccttatgaaaatttaataaatttaataacagcaagagatgcataatctgaaaagagtatctggcacatcattcatgaaagtattcagtatgattatcaagaaatataaatttaaaagaacaaatacaatcactatattctaaatcaaacatttcacatttcactcaatttcacttatatagcctggtaagcaacattaggtccaactcttcagtgactcaagttgtcaaaattcattatcagtatattacttacctctttttctttatgataacgcaagaatagtagtttagatgatggtataaacagtttttctacaaatgatgatggcagtttcgtatttatctgttcaacaatctaaaagaataaaatttttaaaaaatgagcttctcaaattacaaaaagacatggagaaaccttaaatgcacactggtaagtgaaagaagccaattgaaaaggctacatactatatgactccaactacatggcattctggaaaaggcaaaacgatggagacagtaaaaagatcaggggttgccatgggcttaagatggagggagggaggagtggggagagggaacgaggaaggagtgggtagaacatcaaagatttttagggaagtgaaactatcctgtatgatactggtaataggggatacatgtcattacacatgttaaagtccatagaatacataacacaaagtaaactataaaattagttaataataatatatcaatattcactcctttgtaataaatgtaccacactaacacaatatgttaatgagggggaaactgttgggatgaagaaggtatatgggaactcattgttttctgctcaattttctgtatatctaaaaaataaagtcttttaatttagaaaaatatatctaagctatattttaaggccttaatactgtgacattaaagtgtttagacacctaaataggacacacgtattttacagttatcatgggcattttttcacattagcaaagagaggtgtaaatctggcagaaatgctcagcagaatgtcatctagaatttgctttaaaataatccagctggagatgaaaggatagcaaagaggcctagatgaaaccagatgggccatttgtttctaattatagaagctgagtgttaaatatgtacaaatttattataccatgctccctatttttatgtgcttcagaatgtccataataaaagtggggggaggatatttatggttaagaaattaaaggaggccggccgggcgtggtggctcacgcctataatcccagcactttgggaggccaaggcaggcagatcacgaggtcaggagatcgagaccatcctggctaacatggtgaaaccccgtctctactaaaaatacaattgtgccactgcactccagcctgggcaaaagagcgagactccgtctcaaaaaaaaaaaaaaaaagaaagaaattaaaggaggccaggcatgattgctcacacctgtaatcccagcacttcgggagggcaaggcaggaggattacttgagaccaagaatttaaggccagtctagacaatgtagtgagaccccttctctccaaaaactacaaaggttagccaggcatggtggcatgcatctgtagtcccagatagtcgggaggctgagtgggagaatcacttgagcccaggagtttgaggctgcagtgagctctgattgtaccgctgcactccagccaggggaatacagcaagatcctgtgacaaaaaaaaaagaaagaaagaaaagaaaagcaaaaaagaaagaatctggtgcatagagcaatgtttcctcagaaaaaacgagtaaagctacactgagactagctatcaaccactaaaaatagaggcctggcagagtggctcatgcctataatcccagtactttgggaggccaaggcaggtggattgcttgagcccaagaattcaagaccagcctgggcaacatggcaaaactccatctctacaaaataatataaaaaattagccaggtgtggtggtgcacgcctgtagtcctagctacctggggggctgaggtgggaggatcacctgaacccaagaggtcaaggctacagtgagccaaaatcatgccactgcacttcatcctgtgcaacagagtgagaccctgtctcaaaaaaaaattgcattaaaaataaaagtaaatagacactaaaatgaaagcatagattataagactgatgaatgtactctaaaaaataatataataaagcaaagcccttattttttttcttttttggagacagggccttttttgtcaccttggctgagtgcagtggcacaatcagagctcacttcaacctcaagttcctgggcttaatcgatcttcctccctcagcctcccgagtagctaggactgcaggtgcacaccactacaccaagctaatttttgactttttgtacagatggggtctcactacattgcccaagctgtgccagaattcctggatgcaagcaatccttctgctttggcctcccaaagtgctgggattacaagcatgagccaccatacccagacaaagtccttaatttcttacatatcgatttaagggcctgaataaaccaacacattaaaaaggaaaagaataattcacataccagcgtgagtaaattcaagactgagatgatataattggtaccacaagtctggcaattctccagttggtctaatccatatgtaatgaccatgtcacaatgtatagtcatgctaggatccaagctgccgagcaaaacaccaacacactcattagcagctgtcaacacagcctcagaaaaaaacacctggtttgcagccgtcacacatctcattactctgtacagaacctgtaaatggggaaaacaagcagctttttacaaaaattcacgtgcttccacaaagcaagaaaatactttttatttaatgcaatttcaactgaaaattaactgcttgccttgccagcagtctcttaatattctagttctcagtagctgaataataatgatccctttactacaatatgtaaacatgatcttggctaaaaaatcctaaagtgctactatgacaggaaatggaacctgccatcctctatttcccatatacccaacttcgtttctcccaatgtcactaaatggctgaagctcagaatctttatcatgaaatacaccacgacagtaatggtattgacagcatgggaatagcctgcccacacatactacaagctagctcttgggcttttgggaatcaatctttcaaaactgaacatacaagtcactttaagcttattaaagtttctatctactgatggtctcttttgaaagataagcactctcatgcttaccacataatatcttcaaaaatcatattatttccaatacacacacaaacaaaatcccccacttaactataatggccaataattgtgtactaaatttctaataaaatgggggagaaaacagagcaaatgtttaaaaatatttctataatatttaacaaccaatacatacaggattttatttagtctacccatagttttcattaaaagtatccttggaggttgggcatagtgactcacatctatcatcctagcactttgagaggattagctggaaggttctcttgagtccaggagtttgagaccagccatgtcaacataacaacacctcatctctaccaaatttgtttttaaattagttgggcgtggtggctcacaccagtagtcccaccaactacttgaggctgaggtgggaggatcacttaagcctgggaggtcaaggctgcagtgagccaagatcgtgccactgcactccagcctgggcaacagagaccatgtctccaaaaaaaaaaagagtgggggagagagggcggagggggaaccattcttggccatgcatgcacagtggctcatgtctataatcccaacactttgggaggctgaggtgggaagactgcttgaggccaaaagttcaagaccagcctgggaaacactgagaccccatctctacaaaaataaaaaattagcaggagctgtggtgggaggatcacttgagcccaagatacagaggctgcactgagtcgtgatggcaccaccccactttaaaaagaaaaacaaaaaaagctgggtatggtgacacccgcttgtagggctgagtgaatgggaagttcacctgggcccaagagttcaagactacagtgagctatgattgcactactacactccagcctgggtgacagagtgaggctccagctccaaaaataaataaaaaaaataaaaaccccaccattctaccattctcaaaggcctaaaagatcctcataaatcaatatacacctatcctataaattatgtcccttttattttatgtctgaattaacggctttttatttcaactctgtacagtcttcaaacaaccaccttttagacattaaaaatgaagcaaagatattaaaccattttgaaaccatattggtttaaaataccaatatgctggtttcatttatctttaagttctgacatttctgctcaagtacacaacttactatataatcaatatcctattttatttagcaacatgttcagcaaaagtatatgctcctaaaagcgagttttatcctaacagtaaaattttcatcagttagattaaattttttatgactgtatcacacatgcttctttctccttattcaaagcagagtacaatgcctggggttcacttcttgtgtcttttccactgaaccctcattggatgtgctatatacagtgcagctaatgtttgaggctgctgaagtgtggcaatctagctacctcatttttaatttgtttatgttctttgatatcaggctatcaaagaatataaagatatacaagttttcatatgagttccatcttatgctcagagaaggttactttctgaggcttctcctatagtgtgctattcgtaatatgttgaaaaactaaaaggaaacccaataatttaaaagtaaaattataagatatattatttaaaaatgaaagaataagatttaaaaattcagagtggccttttgtcatgggagggtaggggagttggatgaaaggaggatgagatataacaggattccctgcttttctggttatttaagaaagcagtcagacaatatatacatatatacatacatacacacatgctaaacaaatgaaggattaataacagttcacctggtaaagagaatcatttacaatgtaaaacaattttatttttgaatgacacttcaaatgcccaaaagcacttacaactgttacgtatgcctcagtaattggaggacccgaattgggctgaagcgttccccaatgctcctcagcacagtactaaatacccggagaagcgcagccagctttggtgatgacactgatggaggagggacgtcttcatccactgattccccagaggccacatggctgaggtcctagatgtgaattcacagcattcttaataagtagtacattgtttaaaaaaaaacaaaaaactctaaaatatttcaatcaattcattttagaatagatttttaggcttttagaaagagaactgtggcccatgagaatattcatgactctgaatataaaaatgggttttacctaattatttcaaaaagccaacattaaacccaatagacaacaaattaaggaaataatctcttaaatcaactcagaaagctgttggggaaaaataaattctagcacatatgctctagttatatgtaggtataaatgaagacggaagcttttgccactcctgaattagtttttggctaaaaatctcattctaggtattctttgagccactcagctcaacagtaagtcctccaaaccaagagcatgcacatgaagagcaaagggagattacaagacctggtctacagatgtgtaactgaagaagtacgatatatgaaaaggacaagattcgcaaaaactaggatactagaaccaatgtatacatctacctaaaattaagcaccaaaataacagaagagaatgagatcttaaggataacaaggggaaacatctctacaaactagaatgtgtggcttatgagaggtagatcagctttaaacgtgggctgtgaaaaaagacattctaggtgtgggggcaaagaaaaaacaacgcagaagcaaaacatttccttgcttttctaggaaagagtaaacacatcagtacagctaaaggtactgaattcctgttgactacaagcagcaaagatgaaaaaaacaagatgaggccaaaatctttatgggagccttgattggttgatctgaataggggagaaacacaaagagattcagataagagatggcacagagttaagccatgacagtgcggccagaaaagccaagtaccagtaacagaggcttcagcagcgctcttaaagctcctatgctatattcgtacagccacaaaagctggctgaagccaaggcttgtcctccaaagtacgattcaagttctcctgtacatatgtaagaggaaaatctttaggagcttttggtgttttgtgtttttttataacacaacatcaatttgctttaagactctgaagactggggacaaaaaataaaaataaataacaaaaaatgtctttagaaaaataccagctaccaagagtatgtaaagctttgcgaaatacgaagcttgcaacgtttcttttagtctctccagtaattctcctggtaatttaaacacatctgaaataaatgtttaaaatactgactgggcacgggggctcatgcctataatcccagcactttgggaggccgatgtgggtggatcaccagtggtcaggagtttgagaccagcctggccaacacggtgaaaccccgtctctactaaaaatacaaaaattagctgggcgtagtggcgggcacctgtaattccagctactcaggaggctgaggcaggagaatcatttgaacccaggaggtggaggttgcagtgagctgagatcgtgccattgcactccagcctgagtgacagagcgagactccgtctcaaaaaaaaattttttttcaaaatattgcgatgggcttgtaatttctgcttaaatgtcaggaggtctgagccattttaaaataaatctagcacaattttaagattttttcttaaccaaaattttaagaaacagctttctatatactcacctcagcatatgcttccatgtcttctagaaactgaccaagaagagtcgtaggaaatgcaagatcagctacccaaaatggctccaaactctgcaaccacccttggaatcgtataagaaattgtgaaagggtaggggggagaaaaaacaccaaaaaatccaaattaaaaaaatataagaggctcgttttaaaaagtatctggttttcaagcagcataccctaaaacatgtcctatatcataaaattaagactgctaaacatgctgatcacgattaaccaatacctctttaatacctctttaatttctgcagaaattaacttgtaaatgttatttccttactttttcagtaaatttcatatctatattgtcactacacatgacttaagactaaaatgccacaatctaccattggcctggctaatcccagggccacatctaaccattaaaggtgtatactcatctcctcagtgaaaatgaaacagaccactatcacctgaatatcctattttcaaaagtttattacaccaagtaagttacgagaaactatgacacttgaaacaagctgaaatgtgcaaatgagccacgctagtcattcacttaaatccaaaaaaatgggaaacaaaaccatttctcatttatgacaattctccaaattaaccctatatttccttttttaaaaaaataaccagaaaaacaataaaatgtgacaaataacttggatcttccattgtccacttcagggtattgccactgcaatatattcttaccatatactttcctaccagtacaaactacaaataacttgggtaagtcctgtctgtacttactctacccacctactagtaatttcctctgaaaatatatatttagctaacaagtcacgttcatttacaataaaacatttctctgaattagttttcttgcattattaaagaaatggtattggccgggcgcggtggctcacgcctgtaatcccagcactttgggaggccgaggcgggtggatcatgaggtcaggagatcaagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaagaaatggtattgatagatggtcactgggggaccactgctcctccccgacagtatttaaataactggtataggctgcaagacttaccagatacctgctgcgtgagcgaaggtttctgagtatgatctctatgccatccaactaatatatcaactgtatccttgatggaaacaaagagagagggggccaatcattttaagatattactgccattcacctgtggaccatttcacagcaaaagatcctaaaaggagcatctatgttctacctacttgacattctagaaacttagaaaggggagaggggcaggaaaataaaagaactacatttctgacaacaatgaaatagtttattttcttcaaatattttaaggtacgaacgtcagaaagaaaaatgcggcatttaaccctggaacctcaaatatcactgattatattcaaaggagcagaggcattgttttccatctgattcctcagttcctcacacacacaaccatccccctcaccccatgatctgaacaacggaatgaggaactcaccctaaaattagcgctgaaaatatgagggtaacatcgagccaccaaaagaatgcacttaacacatttgcaaagcaattctggtgtatccacattttcaagaattgactgcaggctggtcattacaagcttaaaaataaaagttacaaaccgtgaacattcaacaaaatagggagaaaacaagcaaattaggttcattatttactgactacataaaaaactgagtatgagaccaagaaaaatagattctgtagttttagttaaaaaaaaaaaaaaattcacttgtaaatcccaactgcttgggaggctgagacacaagaatcgcttgaacccaggaggcagaggttgcagtgagctgagattgcaccgctgcactccagcctggacaatacagccagagtccatctcaaaaaaaataataattaataaataaataaataaattgaaaatatttcgctccactaagatgttaagctaaaaacaaatactgctttctcctcttcaatgtttgttaatattagtcctttgacatcagttaacattagtccttaataacatctgtttacaatatccctaaatgctctctttaagattctacctgtgattaaatttcaaatacaaaaaagtaaaatggatttgggaaacttttctataaagtacaacaattactttgcaatccaaaatataaagcaaattttatataatttatgctttagtatattagtacttgcttcatattaaaattaaagaagatcagtatggcaccacacatgaataacatgcaggctcaggttaccattatacataaatttttaaaataaatatatggcaaaaataaaataataaataactatttgtcattccattgaaagaatatttattttgcagctgttaaaaaacatttttccctaaaaaaggaaaagctgcgctttacatagcaatcttataaaagaaatgctagaatcagaaaaccatcattttacgctgggtgcagtggctcacacctgtaaccccagcactttgggaggacgaggcaggtggatcacctgaggtcaggagttcaagaccagcttggccagcatgatgaactccgtctctactaaaaatataaaaattaacagagcacagtggcacatgcctgtaatcccagctactcaggaggctgaagcaagagaactgcttgaacctgggaggcggaggttgcagtgagccgagatcgcgccactgccctccagcttggacaatagagcaagattacatctcaaaaaaaaaaaaaaagagaaaaagaaaaccattattttgcaatagccaatgttataatctacacaggcacagactatcaatgctaaaaatcatttaaaagacatcttaagggtaattacagaaatttgaatatagaacacatatgtaataaaattcattttcttaggtatgattacaatattcttgttatacagaagaaaaaccttattcttgggagatgcatactaaaacattatggggtgaactgtcatcatgtatatggttttcagatgctcaacaaaagtgtgtgagaaaataaaactgtggcaaaatattagtaactggtaaatctaggtgaagcatatattatgaaattattatcgtatttacaggtatttattttactggtgcatctatctttctatgaatgtgagaattttcacaagagatgggaaaatgttcataattatgcatgcagaataagcccaagctggtggcattctgttcagttacaggtaattttctgaatcctccctcaaatttttctcaaacctctataatcaagggggaaaatgtttcgttttgttttgcttttttgagacagggttgcctataatggagtgcagtagcttgaccacagctcactgtagcttcaacctcccaggcacaagcgatcctcctgcctcagcctccaagtagctgggattacagatgcatgccaccacgcccgactttttttttttcctttttttgatagaaacagggtttcaccatgttgcccaggctggtctcaaactcctggactcaggcaattcaccggcctcagcctcccacagtgctggggttacaggagtgagccaccatgcccagttaaaaatacattttttatttaaaaaaaaaaaaaaagaacattccttatatttcctttatattttttaaactacatacccaaaataaagcatatcaaaaactgtattaaaaaaaaaaccctaatatcagatattccaaacacaacaataccataatttaatcacttaaaatcttactcaaaactaaatcaatgatcttttaggccaggtgtggtggctcatgacactaatcacagtactttgggaggctgaggcaggaggatcacttgaggtcaggagttcaagaccagcatggccaacacaatgaaaccccatctctactaaaaatacaaaaattagccaggctaatggcacactcctgtaataccagctactcgggaggctgaggcaggagaatcgcttgaacctgggaggcagaagttgcagtgagccgagatcatgccactgcactccaggctggacaacagagcaagactctgcatcaaaaaaaaaaaaaaggaatgatgttttaatatattcagatacacaaatgtgaaataaaactaagtagagctggtattcatttacacataattatcttataccatttggaataagaatttggggcacgttagcaaaccaaaaggctcagaaagaagttgtgatatttagttcttgtctccctctacaaatgtgaagcactcttctatccagcattcctagtggagttcctattttcaaatttgcaaatcattctggtcctaagcaatctcaaaaaaacatttctaaaaaccaaagaggaaaaaaatccttttttttttttttttttttttttttttgagacagagtctggctctgttgcccaggcaatggtgtgatctcggctcactgcaacctcggcctcccgggttcaagcgattctcctgcctcagcctcctgagtagctgggactacaggcacgtgccaccatgcctggctaatttttgtattgttagtagagacggggtttcaccatgttggccgggatggtttcgatcccttgacctcatgatgttcccacctcggcctcccaaagtgctaggattacaggcatataggccaccgcgcttggctgaggaaaaaaatcttaaaactaacttatttcaaatctaacttcaacgtgtatctttttttttcttttgagacagagtctcactctgttgcccaggctggagtgcagtggcgcgatctcgactcactgcaagctccgcctcccaggttcacggcattctcctgcctcagtctcccaattagttgagactacaggtgcccaccaccacgcccggctaattttttttgtatttttagtagatatggggtttcactatgttagccaggatggtctcgatctcctgacctcatgatccgcctgcctcggcctcccaaagtgctgggataacagacgtgagccaccgcacccggcgtgtaagccaatttcttagaagaaatctctccctctttctccacatatatgcatatatgtatgtagcactaatccttgaacagtgtatcctttactcaaactgagaaagaggaatttttaaaacatatttcctatcagtagataacccctattctatgtttcccttcttcaagctcccctccaaggacatgtgttaagggacaattttcttcccaagtacatcatgcatttttcccccttcattcttacctgcattacagatgaaaaggctttcttttctcctacagtctctagtgctttgtaggtggcacataagtagaggagtttaacttcatcttttgcagatgagctaaatttgctaaaaatccacttgaagatcttctcagcctcatagctcagagaagcacaaagaaggccaagacagcaagctccctcctgtctcaactcctgaagcaatttgctactgtgtttattttaatgcaaacaaaaaacacacacaaaaggcttaagttttctatgatgacacgagtaatacatcttacaaaagaatgtcttaagtggttttttaaatttctattcaaactacataaaaggttgaaattttctccactctaaatactacattctgtctagcctgcattgccctcaagtatctgtctgacattactttctttttacaaaatcaattatttacaaacagtgagggaaggcccaaaaatgctaaattccatctcaaactgtattaaataactctcagaaaagggcagcaacaaataattagataaaacactctatacataactacattctacataatatccaatatgtaatgactataaaataaaaaatggtaatagttaaatacagaaacttaaaaggataacagtaatgatttacatagaactttaataagtaactctataaaacaaaaccatcaaaaggcactaaggtttatgaccagctgagataaattttgggtacttgccaacactgcaaatctttgggaatcaccataacaaaaaatgaccacacacctctggagacgctaatagccagagaatatatggtttggatccactcttacccaaagaaggaaattcctttttacctctattctctaagcagtttcaaattctctagtttacaaaaactaattttattcttcatgcctgcatcaagagtttatgccattccataagtcaagactcagttatccagtgagactagtaaattaaaaaaataaaatattccagccaggcacggtggctcatgcctgtaatcccaacactttggaaggctaaggtgggtggatcacctgaggtcaggagttccagaccagcctggccaacatggtgaaaccctgtctctactaaaaatacaaaaattagctggcagttgtggtgcatgcctgtagtcccagctactcgggaggctgaggcaggagaatcacttgaacccgggaggtggaggttgcagtgagctgagatcgcaccactgcactccagcctgggcgacacggtgagactctggctcaaaaaataaatattcttttcaagtggattccatttgtattcaaccgtaattaacacataattaatgcagataaaaatgacaagacccactgaaatgtcaatagatgttcataaacaaagccagtgggtttgtcttcttgtgtattgttaagtaatttctaaaaatatattttaaagtcatttaaaccgaaccattattagttacttacctttcattaagcacatcatgtgcagcagccaagatattatccaattgtttaactagtacctttaaaagaaaacacatttataaaaacttcaaattcctatacttttaagaatagcattgtgtacttttttacttgtcttcccctccaaattctaattcaacagtactttactttctttattattcccactccccaatgagcatgtatcaggaatgtcatgtttcctttcagcctatgaaagaaattcacccactggaaacatagagctgtgatcatcaacaaaaaaataaactcaaaaagtttgttttatttactttgaaatccatttgaaaaattgactgatggatggagggatagatggagagatatgtgacaaggcagtatttagggcaaaacattaacgacaaaaattagatgatgggtttaacagattcaatgtcaaattctttcaacttgctatatatttgaaactactcataataaaatttggaaggaggagaaacttgctttgatccaagtgtcatctgcctcactagaccattttcattaattttctcctgctcattgtcaagttctttttttttttttttttttaagatggagtttcactcttttcgcccaggctggagtgcaatggcgtgatctcagctcactgcaacctccgtctcctgggttcaagcgattctcctgccacagcctcccatgtagctggaattacggtcatgtgccaccacgcccagctaattttgtatttttagtagagatggggcttcactatgttgggcaggctggtatcgaactcctgaactcaggtgatccgcccaccttggcctcccaaaatgctgggattacaggcatgagccaccacacctggcccatatcaagttcttaattggtgtaaagaaagtgaagaaaaaaatttaacccttcctatactttgttacatttctgttgttgttttaagagacaaggactccctctgtcgcccaggttgacatgcagaggtgtgatcatatctcactgcaaccctgaattcctgggctcaagtgattcttccacctcagccaggtgtagtggcacatgcctgaagtcccagctactcaggaggccacagcgggaggatagcttgaatccaggagtttgagactgcagtgagctatgattgtgccactgcactccagcctgggtgagagcaagatcttgtctttaagaagaaaaagaaattacatattagagagcattaagttcttgatcatcataatacagactttccccattcttaaactactcaaggtagcattacctagtttattatggaaacacaaaaatcctcatatttccaaacatactatacttaccagcttattttctggttgctgaataaattctttcaactgctttacagtgaccaatcttcagtctctgtcgtcttcccgggtgatcctccgaagaagatttgacagtcgagactcatcacaataagacatcgatctctctgtgaatatataaacattttgttgtccattgagtataaataagcaaaggaatttttaaattttaaaataatttttaaatttttaaaattaaaaattatttaaataataattaaattattatggtggctcatgcctgtaatcccagtactttggaaggcgggtagatcacatcagttcaggagtttgagaccagcctgggcaacatggtgaaaccctgtctccacagacacacaaaaaattacataaactagccagccaaggtggtgtgcacctgtagtcccagctactcgggaggctgaggcaggagaatcactggagcccatgaggtggaggttgcagtgagccgagatcaccccactgcactccagcctgggtgacagagcaagaccctctctcaaaaataaaattacatcaaaagtcacagtccactggtcaataaaagctcagggaatataggtcctatcgctcttttgttcaactctatattccaaatcccagcagagtgcctggcacataacagaccctcaaaaaaatatttgctgaaggaaacgagaaatgaataaccctaggccagctgaacacctcattccagaggactggctgggagagaaaaaagaaaggccttagtaacaacttcctttgggtccattccaaactgttttcaacatgcaggtaaagagcctgggtgtaggtaaattaaacaacttccaaggggtacggataaagcctcaatcgagtaaaaacaggatataggcttctacttatcatctaggtatcccactggaggaaagcctcttattcacattatcatcatttccctgggatgaagttttggggagccataatcacacatttagttcaacaaatgtctaattatcatctaccacatgcaaggcatgcctccactagaaaggtagcaaaccacaacttttctccccttattttttaatcacaagaacaagcacacaatagtgaatactattagtatattaacaatgcctttaaaaactagatttttgctgggcgaggtggctcttccctgtaattacccagcactttggaagggcaaggcaggcagatcacttgagcccaggagttcgagaccagcatcggcaacatggtacaaccccatctctacgaaaaatacaaaaattagctgggcacagtggcacatgcctgtaatcccagctactcaggaggctgaggtgggaggatcgctttagcctgggaagcaaaggttgcagtgaaatcacactagtgcattccagcctgcgtgacagagcgagactgtctcaaaaaacaaaacaaaacaaaaaactcaatttttgcaaaacattttcaactgtgctatttaccataattagccaatacatacgtaaacaacaaatcacaaagggtctgacagtttcatttctaaggtatgagaaaaaattgataataaaagaaaccagaaggctgggcgtggtggctcacacctgtaatcccagcactttgggaggccgaggagggcagatcacggggtcaggagattgagacctgcctggccaacatggtggaacttcgtctctactaaagatacaaaaaattagccgggcatggtggcacgctcctgtaatcccagctactcgggaggctgaggcaggagaatcactttaatctgggaggtggaggctgcagtgacctgagatcgcgccattgcactccagcctgggtgacagggagatactccatctcatagataaataaataaataactacaaggggagcaaaacacactggatccttttggagggtggggggtgggaggagggagaggatcaagagaaacaaccaatgggtaccaggcttaatacctgggtgataaaataatctatactacaaaccctcatgacacaagtttaccagtgtaacaaatctgcacttgtatcctgaatttaaaagttaaaaaaaaaaaaaaaaaaaaaaaagaaactacaatgtctgagagaagaataggatttttacaaatccgtagcccatagagtatttcaataaggacagataccaaaaatgtcatcaagttaccagctgggaaattaggctctacttacaattctgtcactagcaaactacctttgaagaagaggaattgtttactgaactactttagagtcactgtttagcttctataatatcataagtctaaggcttcaaacactctgttttaacaaacagcatacatagcctttgaattcattccacttgtgaaaacataaaaagaaatcagttttttaaaagttatataccaacaataaaagctacaggcacaaagattttcaccaagatacacgaagcacacacacagtataaaaaaaaaaaaaagtcaaaaactaaatgtccaaaaagtaattacatctgacaaagcccataactcagctttaccgataaatttctctttaaggaaaaaaattatcattacctctaatcctctgaactttcttttttgttgttgtttttttgagacggagtctcgctctgttgcccaggctggagtgcagtggtgcactcagctcactgcaagctctgcctcccgggtagctgggactacaggcgcccaccaccgcgcccagctaattttttgtattttcagtagagacagggtttcaccgtgttagccaggatggtctcgatctcctgacctcgtgatctgcccgtctcagcctcccaaagtgctgggattacaggcgtgagccactgcacccggccaatcctctgaacttccaaggcactcacctatacagtgaggctacgccataaggcagaaatgctatcagtgtatttaactttagaaaagtgcccactctaggcagggcccagtggctcacgcctgtaatgagcacatgtgatcacttaaggtcaggagttcgagaccagcctggccaacatggtgaaaccctgtctccactaaaaatgcaaaaatcagctgggtgtggtggcatgtacctgtactcccagctacttgggaggctgaggcacgagaatcacttgaacctgggaggcggaggttgcagtgaggagagattgcagcactgcgctccagcctgggtgacagagcaagactctgtctcaaaaaaatatattgaaaacaacaacaaaaaaaccagaaaagtacccactctagggggcggggggaaggagagcatcagcaagaatagcttaatggatgctgggtttaatacctagatgatgggatgatctgtgcagcaaactatcatggcacacgtttacctacataacaaacctgtacatcctgcacatgtaccctgaacttaaaagagaaaaaaaaaaaaaagacagaaaagtaccccctctatatatatatctatatcctccacaggcccaagagttcaaggacttgctgtagtaagagcctactatgcactatacattcaatatccacgataattgggtaaaccttttctgtaagatcttatccagtcttctaatcttgttttaagagaattctcttttaaaatgtactataacctttctagtgggaaattaacaattcacaggaaaagaatgtaaacaatttttacctgcacagtagactaatcaacttatgcctgtgcaaggcgttagtaagaggcatccagaataagaggagatacaagtctttggaaggtgtatgtgattggtccccattttcccagacttaccctgtgatttcctcatgtctttggtggctaaagcacgactgccatgctgaacactggtgaactcagggctggtcacattgttaaccctcagctcttgccccaacgacttccgaccataagtattttccccagatcctccattgacactgtagccacctacaaacagcaatgtgtacgttatttaaatatgattgttcgtttcattcagtcaatttcctgatagctcaggatcttactactcaatctgcagctcaaccagcctttgcttctcctacctttttcctgtactgtctgccttgaaaatcattttcatttcttttaatacacctttgaagttaaattaattttattttgatcccttcattggaaaataagcaaagaaatgaaaactaaattaaatcaaattttgcaccttaaaactttcttgaagtttagagacagtagccaagaggaacttcaaccttagctaaatatttttgaaaataaaaacaaaaatagtattgtatcttttttgtaagaaaactgcattgatgaattatgtacggaaaaattttaaattttaaaaataataaagtggataaacgtcctatgaagttttcagaaataacactgcatttgttattcgtattttaaatatattagaagaaagcgagaaagttgggggtgtaagaaggcaagaaggtgggataggtaggttcaaaaaacatgcttgtagcaataagaaaatatatatacccttttcgtcattctgtatgtcagcgtggactctggtatcatcgtgcctttgccgagacaccacagctgaatttgaaggttgcagtccgtaagaggaagaaccacctctatctctggatgaagaatattttaaattacctgggtcagctgatgcactatcagttctataaaaagagaaaagtttaagattagaactttaaataacataaataaatctttctttaaacaagcctctcttctcccaaattttacatttaaccattactattgtatttaatgtaatatgtactatatattatatgtaagcactcagccgtctaataagaagtctttcactgggaagagattctcaatggatgaaatgccaacttttcagtctcttctactgttctaaagacccattcagaaatacgaataactactgggattagggtgactttgctggttttagcattgaaagcctcctgtcccaggcaaaacaggacaattggttactctggtccagtgttctcctcacatgacttgataataagaataattctttctaaattctcccccatggagagggttaatcagtcaaaacatttcagcctttcctatcataaaaataaaaaacactggcagcatgtcagggacaggcaatgtcttaccaagttattttctaagtactgattaggtactgtagtattgaagaccccattgaagatgccttaattgtaaaggtagcaatcaaaattttaaaaagtaaaaaagaagacattttaagaaaataaaaggtatcagaaatgcaataacgttatatcggaaagttgtagttcataatctatttaaaatttaggtactgtttagaataatacctgatgcttattagtaaacaagtagggtacagccaagggtaaaagtttgtcctcatctaagtatctgctctacgcttcaactgcctcataagtaaaacagagctgagttacaagacttctcacgagtgttactctttcagccatcaatcataaactattaagaaagaagacaacaaaataatctgttatagcatatgaaaaatccaagtaagttcttcccctactgattttctcctgagaggaacaactttgaggaaaaaaaaaaagaaaatcacttctatgatatttactaaaaatgctttctcaaccttttagaacctgaatcttttagaaaagtttaggacactggcaaggccagaaactaacctattcctctacgctttgcccctctatggtgtaaaagtgacagcagtgtttgtatactgtatatatttcatttagagtttattagtctttccttgctcccaaaaatactaaacataaaactttgcatgagctcaatcagttggacaccttgatctgcacttactgcaatcactgttaatacagaatgcagacaataggtccaattaaacttggatatctaactggtacaagtcattacttacaaaggatctcaatctgaaacttcatgaaattcaaaacctagcatactaaaatgactacggctccataaggagtaccttctaatattcagagttcgcttattcataaagctaagtacttcgaacataagggaaaattaaatctatggaatttcaagaaaaatgtatgagaatattttctgagtatactaagtctataagcattaaaatattaactcaatggaccataacttttttaaactaatgaaaagacattccttatgtacctaaaaatagcacatttaacatgcgtctatataaatcatagcataccattactttctgaaaggagactgaaatgtaagagagcttataatcttttctgacagggtgtgaactttatatgtacgccacagtaagctcttattagatgagcaaataaaataagcacttgactaattcagaaacacaaagataactgaagtctgccaatatttaaacatatcttcacttcctgttttcatcatgtttacttatctcctatactacctttactattaagagttaaatgtttgtatcattttctggtgacacagtagtaccataaggcagcagagaatacaagttaaaaaaagatctgggctcaaatcccagctccagcactgaaaagtatgtgtgcctttgcacaaattacttgatctccaagccttggttgtctcttgcataaaatgaggatgatacctatctaacatgtaaggttgttgtgaggcttaaataagataatgaattataaagaaacacttagtttgcagggtatgttaaaagttattatgaccataatacaaaataaactcagtttccagtctaaaagacaatgtacaaacagttcatgagtatatgaatataatcaaaacaagtttttacagtcaatatagagcaacttaaatacttcactgaagaaagcaggtaatctgtggctaccaacaatgtgtttccaactaggaagcatctgatttcaaactaaactgtaaaaccaggagcagcttccccattggttagaaataaggtttctaaatcccctaagttatgaacactgagatttttttcccaaaaaaatttgtgttttcagaaatatagcaaaaaaactggaatagagccactgtctcagaaatacctgaaaactccctagctgccaaattattttaatacaaattgatcaaagcatccccaaccagaactcaggttgtaagcattctgaacctaaaagcacaaaatggtttagcatttatacgaaatttctatttttatacaatcttgactgcttaggtttcaaaaaatgtcaatgtcaggctgttagcaccaacaagatcatcccagtccaataaatagaaaactgttaaagaacgggaatgagaacttaaaatgaggcaatcaaagccacaaaatagaaactgcagatttgaactccaagaagcaggcatgaatgttaggctagttagttagaagagctgaaagggatatcatctgccagaattagtgtctcaatttagtgaaaaaagaaaatctatctgttaagtctaagaatcctaacaaggatccaaaaatacttctacagcccctttaatattctaaaaatatcatggagagaaaaaaaaagaaatgcataaatttccccaaaacgatcaaactaaagttaaagcctgaggtacatgccacatgagaggtaagtttctaaagctcatacctcaaaaatcgcatactgtgtaacatggagcctttgtgatgttttgcatcaagtcaatctgtaagacagtagttacaatattagtgaagacagtgggttaaaacatttgttgttcaaacatggagcaaatatcattcatgagttaggtgcctttagttgaactatggtcccattagggttcatacattaaagcaaaaattgaggtggaaagccactccgtgccttacaggataaagaggcttaatgtggcaaccaaaaaatttttagtacataagagaatttaaatgttaactataacatacaaatcacatgcaaatatagttaccacttattttagttacctcttctcaatatacagaaaaatgccacaaatctaggaggccactggtttcaaatgaccggaatccttagacctcacaccaacaatccaccatgtggtggggatggtatcgcctgactaaatgtagtcttgcagtccattcttgtaagtattagagagaaaaagagagagagcgtcatctctgcaaagtgtgaagtcagggacttccctactaggaagcatttccataaagcaccccaaaatgacttgatgcaaacaccacacctagtggtgtcactggagtaagcatcatattacttcaaattgcttttacctaggtttattaagggattttgctctcatgctgagatctaatttgtaatggatataaaccaggaaatgagatttgcactaaagccaatgaagtaggaatgtacttattctctaaagtagcaaagatagtctcactgtcacagagcagttataggatatgttgctttccatactaatggttaataccacttggaaatgatttacccttcaaaaataaattcaaggttttcccctgtaatgcctcttacctggattcaaacatgctttaatgaggaataagagaaagggtgaaactatgaataaccccgggccttgtatcattacattagaaacactgctctaaatatgagtctatggctaaaatattaatttgagaggctcagggaatttattatacaaatctcttcttgcagagaactttaagttcaaatttaataaaacaaaacagaaccattccacgtcaaaattgtaaatgagtatgcatcagttttgcaatactgagatactaaattaatataatttattggtaaaactagtttaactacctcagtattaagtgtctataataaccaaatcttaattatccatttatgggtgatttgtttccttttttgagacagggtctcactctgtcacccaggctggagtgcactggcatgaccatagctcactgcagcctcgacttcatgggttcagcctctcaaacagctgggaccacaggtgcatgccactccatttagctaattttttatttttatgttttttggagacaggtgtctgattatgttgctcaggctgctctcaaattcctggactcaagcaatcctcctacctcagcctcccaaaatgctaggattagaggcatgagtgaccacatctggactgtcaccaatttttaactgtctctcaactaaacagccaatatagactgataaaatatacttaactattgtaaaattgtaaagaattgtatcttcaccaaggagaggtctggcttttacctgtgaattctggaaggtaatctctaaactcttgaaatgtcatacctaataagagggtcctggccaggagcagtggctcacacctgtaatcccagcactttgggaggccaaggcgggcagatcgcttgaggtcaggattttgagaccagcctggccagcatggtgaaacctgtctctactaaaaatacaaaaattagccaggcatggtgacgggcacctgtaataatcccagctactcaggaggctgaggtttcagtgagctgagatcatgccactgtactccagcctaggcaacagagcaagactatctccaaaaaaaaaagggggggggggcggcggtggggggaaagtgtccttgttcatctgggggctttaggccacagcagagtctaataatgtggcttatggtgggggctttgagtcacatggatcagcttgacctccagtggggctggagactaaggttagccacatgggcatgcaaccatggaaccccagtaaaaacgttggacataaaaaatagagtgagcttccctggttggcaataatccatgagtatggtcgcacaccagtgccaccaggaaggtgtcatttttcacaactctacagggacaggacaattcaaaactccaacatttggaacttccccgaactctgccctatgcacctctacccttggctcattctaatctgaatccctaaactgcaataaactctaactatgggtatgagagctttcaatgagttctggtgagtcctcctggcaaatcatccaacctaagagtggtcttggccaggcacagtgactcaagcctgtaatcccagcacttcgggaggcccaggcaggcggattacttgagctcaggagtttgagaccagcctggcaatatggtgaaactgtctctaaaaaatatagaaaaactagccaggcgaggtggtgtgtgcccatagatccagcaactcaggtggttgaggtaggaggactgcctgaacctgggagggaggaggtcagggcacagtgagccgtgatcatgccactgcactctcgcctgggtgacagagagaggccctgtctcaaaaaaaaaaaaaaagagtggtcttgggaacccccaaacttgcaactagtattagaagcaagggtcatcttatggactggactccctcttactctgcactcatatttaaaaccattaaatatactgtagctcaaaaaaaattgctcctttgttttgaaaaagggtctcacactgtcgcccaggctagagtgcagtggcgcaatccgagctcaagcaaacctcccacatcagcctcccaagtagctgagaccacaggcttaccccaccacgcccagcaacttttgtatttttttgtcccattctctacaacattcccaaaatgttgcccaagctggtctcgcactcctgagctcaagtgatccactcacctcagcctcccaaagggttgggattacaggcataagccactgcacccggccataaattttgttttttagtaacatttctagcaaacatgataaagatttgacttcagtgttgcttattttccttccaaggaacctctaatattctctattttcagaactccaatcaaattagccagaaagagcaaacgaagccaataaatctaggagggcaatagatctgattttaacccttgtttcacatgcacaattgtcttcagagaaaagctgaagaaagtaccccctcacctccatgccccaatgctccttttctctgacttcaagtgggcctctgatgctgcccacatttccctcaccaggtttctttcctttccaaaacatctgtaaaactttctgcaccttcttccttctcccaccactaccagtggatgaccttatagatttctgctccatgagaaatagaagccatttgacagcaccctcagcaagagctaacattttagctcctaacaagagctagtgggcaactgatccaagcagtttacaaatgtttatcatgtcatttcgtgttcaacacaatcctattagttataacttgataactaaggtttcataactggcctaaggttgcacagcttgtaaaaggcagagtcagaactcagacccagtactgtctaatgtttgagctcttcaacactccatcgctgcctgtcatcttccttctaatatatccacaaattcacctgcatctgcacatacaccttttcttcccatcatcttcccataatggaacaaataaacctcctatccatagaaatcatctggatctgtctattccccccattttccaaggtatgtcttgtcttttttttttgagatgtagtctcgctctgtcgaccaggctgaagtgcagtggcgtgatctcgactcactgcctcccggattcacgccattctcctgcctcagcctcccgagtagctgggactacaggcgcccaccaccacgcctggctaattttttgtatttttagtagagacggggtttcaccatgttagccaggatggtctcgatctcctgacctcgtgatctgcccaccttggcctccccaaagtgctgggattacaggcttgagccactgcacctggcctgtttcttttgtacgttgcaaaatctcccattttactactgcttatcacatcgtcaacatatgagcactctcaaaagtcttactttaaaaaaaacaaaaacaaaaacaaaaacaaaaaatggccgggcacggtggctcacgcctgtaatcccagcactttgggaggcaaagacaggcagatcataaggtcaggagattgagaccaccctggccaacatggtgaaaccccatctctactaaaatagaaaaaataaaactacctgcgcatggtggcacgcacctgtagtcccagctacttgggaggctgaggcaaaggaatcatttgaacccgggaggcagagcttgcagtgagccgagatcgtgccactacactccagcctggtgacagagcaagactctgtctcaaaaaaaaactaaaggccgggtgcagtggctcacgctggtaatcccagcactttgggaggtcaaggtgggaggatcatgaggtcaggagttcaagaccagcctggccaatgtagtgaaaccccgtctctactaaaaatacaaatatcagccaggtgtggtggcgagcgcctgcaatcccagctactcaggaggctgaggcaggagaatcgctcgaatccgggaggcagaggttgcagtgagccgagattgcaccatttcactccagcctgggcggcagagagactccatctcaaaaataataataataataaaataaatttaaaaattaagaaaataaggccgggcacggtggctcacgcctgtaatcccagcactttgggagggcgaggcaggcagatcatgaggtcaggagtttgagaccagcctgggcaacatagtgaaaccccgtctctactaaaaatacaaaaaattagccgggtgtggtggtgggcgcctgtaatcccagctagttgggaggctgaggcaggagaactacttgaaccccggaggcggaggttgcagtgagccgaggtcgcgccattgcactccagaccgggcaacagtgtgagactctgactcaaaaaaaaacaaaaaacaaaaaaaccctttaactgcctttctccctctatcaatctaatagcctggactcttcacagacaaacctgttgaaaaatttatcttccttgccttcatttactttttaacccactttaatctgggttccacctgcaacacaccactgaagctattcctactaagataggaactgccactcaaggccttcttggctctaaaagcccatgagcctttatcagttcaccttacaatttctcaataccattctaaagtttatgagttttttaactttaattccagtgactctttctactttatcccaatccaagtattctcctccttctttactttttttttttttttttttgagacagactctgactttgttgcccaggctggagtatagtggtgcaatactggctcactgcaacctccacctccaggttcaagcgattctcctgcctcagcctcccaagtagctgagattacaggcccctgctaccacacccggctaatttttgtatttttagtagagacagggtttcgccatgttggccaggctggtctcgaactcctgacctcaagggatccacccgcctcggcctcccaaagtgctggaattacaggcgtgagccaacgtgcccggccccttcttcacttctttaaccagcttagatttcattgtgtatcatttcaacaacactcttgcctatacccttaactcttaagattttcatcacagccatctggcaaaaccccaatcctggataaacccaacgatccatcaataagcaccacactcccaggtcctccagtgtttacttcccattctatacatgcactatccagacattcccattctcttcaaattccaaaatatcctatccacctgccctccccatacacacattctacttcaccaacaacaaaaaaaaaggtaccagctgggcacggtggctcacacctgtaatccctgcactttgggaggccaaggcaggtggatcacttgatgtcaggagttgggacaccagcctggccaaaatggtgaaacctcatctctactaaaaatacaaaaattagctgggtgtggtgatgcgcacctgtaatctcagctacacgggagactgaggcaggagaatcgcttgaacccaggaggtggaggctgcagcgagccaagactgcaccactgcactccagagcctgggcaataataagagcgaaactccgtctcggggtagggtggggaagataccataaaatatctgcacccgattctagaccttactgaggattccatctacttccaccttactgtaactttgcaaatacttttcccactgaactaaatcccccccataaacaagcaacactttctaatgtatcccattgaaaaatacaaaaacatataaaaaggaaaaactccatcaatcccacatgtccctccatcaaacaatctgccttacttgctgcagccaaactaaagttgtctagactcccctctcccatttcttcagttcttctagctccttaacacacactggtccaatttctgccccatcactcttggcaaaatccattatgacctccaggctgctaaatccaagatacagttcaggcctcaatctgctcatcctttcagcagctttcacagggctgctgagtagggttgagcagttttgccctgcacacaggtgccctgcagaggaatgaggtgggctgaatgaaactccttttttaaaaattctcggctggcatagtggctcacgcctgtaatcccagcactttgggaggctgaggcagacggatcacttgaggtcaggagttcaagatcagcctggccaatatggcgaaaccccatatattaaaaatacaaaaattagctgggcgtggtggcgggcacctgtaatcccagctactcaggaggctgaggcaggagaatcacttgaacccaggaggcggaggttgcagtgagccgagactgcgccactgcactccagcctgggcaacaagagagaaactccatctcaaaaaaaaaaaattgtttatgccaactaattgtacacctaaatgcaccaagttcatgactttctccttgcatttatttatttatttattttttaattaggtctcactctatgttgcccacgttgtagtgcagtgtgtgattacagctcactgcagccttgaactcctgggctcaagagatcctctggtcttagcctccccagtagctagaactataggtatggagtggctctctgcctttatttctaacccaagctaccttacaaccttaaaaagagacgctgcttcgccaggcacagtggctctcgcctgtaatcccagcactttgggaggccaaggcgggcggatcatgaggtcaggagttcgagaccagcctgaccaacatggtgaaaccctgcctctactaaaaatacacaaaaacttagccaggcctggtggtgtggcgcctgtagtcccagctactcaggaggctgaggcaggagaatcatttgaacctgggagacagaggttgtagtgagccggaggttgtagtgagccgagatcacgccgctgcattcccacctgggcgacagaacgagactcaaaaaaaaaaaaaaaaaaaaaagagagagaccctacttcagctctcaattgcatcgcttatcttccccttttgtcagttaagtcctggaagtaccctagaaacctatcatttggcctgggaaattgccaagattgaaaggaaatgtcttactctatgacctctttaacagatgaaggacaaaaaaggctgaaaatgtacaaagatatgcatccctcccccaccagttaaatgccaaacataggccagccacagctgatcacacctgtaatcccagctgtttgggagtccgaggcaggcagattacctgagttcaggagttcgagatcagcctggccaacatggtgaaacccagtctctactaaaaatacaaaaaaattaggcaggcgtggtggtgcacatctataatcccagctactcgggaggctgaggcaggagaatcgcttacccagaggtggaggttgcagtgagccgacagctcgccactgcactctggcctggagaacagagtgagactcagtctccaaaaaaaaaaaaaaggccaaacatagcccattccaaccaagattaagaatcactaagagttacattgcaccactgcacaccagcctaggtgacagagcgagactccgtctcaaaaaaaaaaaaaaagagttagttacacactgcagaaatctaaacaatctcaaaagtagactgggactttataatcaaggtaaaggtgaagtgatgtttaccaatataagaaatgaataggccaggcgcggtggctcacgcctgtaatcccagcactttgggaggccgaggcaggaggatcacaaggtcaggagatcaagaccaccctggctaacacagtgaaaccccgtctctactaaaactacaaaaaaattagccgggcgtggtggcaggcgcctgaagtcccagctactcgggaggctgaggcaggagaatggcatgagcgcgggaggtggagcatgcagtgagctgagattgcgccactgcactccaacctgggtgacacagcgagaccccgcctcaaaaaaaaaaaaaaaaaagaaatgtatgcaaccatttttttcaactcctgaaaatagtcagataataactgtagttattctgataaagttcctttagccaacaggttgaagcacattcccagggaataacatgtttataagattttctaacaattgcatatgttaaatcttctctttaaaaataatcctggccaggtgcggtggctcatacctgtaatcccagcactttaggaggccgaggcaggtggatcacttgaggtcaagagttcaagatcagccagaccaacatggagaaaccctgtctctactaaaactacaaaattagccaggtgtggtggtgcatgcctgtaatcccagctactcgggaggctgaggcaggagaatcacttgaacctgggaggcggaggttgtggtgagccgagatggcgccattgcactccagcctgggcaacaagagcaaaacttcatctaaaaaacaggaaaaaataaaataaaataaataaaaataaaaataatcctaggccaagctggctacagtagctcacacctgtaatcccagctactcaggaggctgaaacaggaggatcacttgagcccaggagtttgagaccagcctgggcaacacagtcagactgtgtctctaaagaaaaaaatcgtcatcatcctaggccagtccagacaacatagcaagacctccaactctaaaagaaaatgaaataaaaaattttaaaagtcaatttaattagaggtctcaagtaattccagaagatacagtctcacaaatcaaatactgagaaaggaagacacctttcaagataatcacactattattttaactgtaggaaaatgtattaaatgaagacagcttttgctagctgctgaaacatactagtaagaacaggaaacgatgctcccaccatgctcagcagtagccagaaatttactgaggtctttgtatttagccttaagtataagacacctaggaaacttcaaaatcatcacttaagccactttaaacccacagtctatacaaaccctttttcttttgttacattttatactaaacacactttaatcagactgacataagtgatttaaaagtaacttttataattcccttttacaagaaaaaaagaaacaatgtttccagatactaagttccttaagagacagcaatcatttattatagatttacagtactacaatttcaaatagtaccagaatctttttttttttttctttgagacagtggcacaatcacagctcacggtagcctcgacctcctgggctaaagcaatcctcccacctcagcctcccaagtaggtgggactagaaactcatgacaccatgtccagcttttttttttttttttttgagacagagtcttgctctgtcacccaggctggagtgcagtggtgtgatcttggctcactgcaacctctgcctccagggttcaagcaattctcctgcctcagcctcccaaatagctgggattacaggcatgcaccaccatgcccagctaatttttatatttttagtagagatggagtttcaccaggttggtcaggctggtctcgaattcctgatctcggtgatctgacagcctcggcctcccaaagtgctgggattacaggtgtaagccaccatgcccagccaatttttttattttttgtagaaacgaggtctcactatgttacccaggctggtctccaactcctgggctcaggtgatccacccacctccctgccttggtctcccaaagcaccaccatgcctggcccaaaatcttgtaattgcttaatactgtatatacattcttataatgatatgatatttcccatatttgtgtagaagatgcatgtggttcttctccaccccctcaagtacttaaaactatcacattggcagagtacaacctttaaatgtttctggcatcctccctcctcccattaaaaaaaaaattaaaataaaaatatgtatatacacgcccatacacactacaacagagggaaaaaagcaactcattgttcaactggtgttcttataagaatcagttcttaaattccaactgtgtagtaaaaggtaagcaagctataagctaccttttaacctatcctttctctatatacgttccatttacattgtacttgccctccaatctatgcaaacagtcacaaagattagattatgtttgctggcttatcatttcaactagtaacaaattcttaaggtgtgaatacaagatatggagaaaaaatgatgatgcacagctatgctgaaatttcgtattgttcaacttgaaatacgtttacagcctaatgggagtacactagaaaatgtagaaagagagcaggcacggtggctcacacctgtaatcccagcactttgggagacagaggtgaatggatcacaaggtcaggagttcaagaccagcctggccaacaaggtgaaaccccgcctctactaaaaatacaaaaaaaaaaaattacctgggtgtggtggcacatgcctgtaatcccatctactcaggaggctgaggcaggataatccaggtggcggaggttgcagtgagctgagatcgcaccattgcactccagcctgggggacagagcgagactccgtctcaaaaaaaaaaaaaaagaaaagaaaaaaaagaaaatgtagaaagagagccactccactgcagagcaattaattctatctccactaatatttttctaaatattcactgaaacagttttaaaaataatttcctgaactttaaccctcccaacatcttcaaaaggcaaaaattaccccctcagagggacacagctggtagtgccaatacaaaagatctttgtcttcccattcttagtccatagcttttttcatgacaccagcctctcttaagataaatatctgtgaaggatcaactttttaaaatacacacattctagctgggcacggtggctcacatctgtaatcccagaactttgggaggctgaggcggaggtatcacctgaggtcaggagtttgagaccagcctggccaacacggtgaaacccgtctctactaaaaatacaaaaattagccaggcatagtggcatgcacctgtaatcccagctacatgggaggctgaggcaggagaatcgcctgaacccgggaggtggagattgcagtgagccaagatggtgccaactgcactccaggctgggcaacagagcaagatgccgtctcaaaaaaaaaaaatatatatattcttaaaaataaagacacttagagaggaatctaaaacacactggttctatttttaacttcaccaatgctaagacagcgggtgtttttttttttttttttttgaaaaagaaaagggaacaaatttcacataggagaatagtttttgaaatctttgcacaacagggtggccatagtaaataatgattatttatttgcaaagagaagacagagataacaatagcaataataataatgtatttcaaacaattaagagtaaatttcaaatgcctcaccacaaaatataagtaagcaaagtaaggcgatagtatgttaattagtatgatttaatcatactacattacacacatatatataaacattacgttgtaccctatgtgtacaattatgatttctgaattaatattagagtggggagaacaataatgattaatttttacttcttcagtaagattacaatgaaaatgtagagagcactagcattatagtaactatacgataggccactttaaataaatggcatcttttacaaaatttttagtcaataagttgattacgacatacttacgaactatttgctattaagtgtaagttaatttataattttagtattttcaaaaaaggaacatattaaaatcctatcaatatttcaaataatgacaaaattaatcatttttaatagaatccttactcaggtcctccaaaaacaatataaactatgacttaaggtaaattcctttaaatctgactaatgaataaatgttaaatctcaaatttcatagtcccagtgctggaaaatctatatttttatttttcttcacgtttatacaaagaatgtacagacaggcaagaaatgtaatcaacctttttaggaaagaatcccaggatttgttttcttttcaattaaatatatatgaattctgggggatactggtgatcatctctggatctttttactcatctaatgagaaaagagtctcattatacaaagaggatagtcaaaaagcctaatgatttcctcacataagtaggtttttctgtctggcaaatctgaagaagtcaacatagaatctgtcattaatgcattgaatctgaacttccactattcaaatcaaattaggacctggaaataaagtgttaacacttcagacaagaaattccagggtttgtatcatcaggaatataaaccagggacactctcaagaggctgaagagcaagagtcatgcactgcttcagagaattaaatactccaagatgaaagttaaaatttcaaacacacatatcacacatacacatcttttaacatcaggttgaaatgctaaagggaacagagtaaaggtatgtttttaattaataaatttaaatgagagaaaactttaaattcaaagagcttcagtaaaaaaaaaaaagaaaatattagcaatgttatcaaatgtggacgaaaagctaatatatgtcactatgtaatccaagacatattcattagtggcgccttttttctgggctattaatatattagatgccatccaaaaacaaatatctagtaaatattaagtttaacgacttcttaaaaacctgtaggttcccaaagacatatacatgtatgtgcagtgaggccactgctaagcctctaataatattcttgtagactactaaagttctctatgatgataaaaagggtaataaaaaaaaaatctagtgtctccccttaataaacaaagaacgagcataacttaggaagttcggtaacaaaaacaatctataattctggtaccagaaatccctctgaggctgggcgaggtggcttacacctgtaatcccagcactttgggaagccaaggcaggggggatcacctgaggtccgaagatgaagaacatcctggctaacagggtgaaaccctgtctctactaaaaatacaaaaaattagccaggcgagtggcacatgcctgtaatcccacctacttaggaggctgaggcaggagaatcacttgaacccaggaggtagaggttgcgtgagcctagatcgtgcccttgcactccagcctgggcaaaaagagcaaaactccatctcaaaaaaaaaaaaaaagcaacaagtccctctgaaaaaagttttaaataataaacaaaagtctataacaggtttttaaataactataaagtcctacacatattacatgaataccaacataataatatgaatatgaatatcaacagggtatccaattccttttttgaaaaggtctgaaaattaatatgaaagaagtaattctgtatgttcagaaatctgttgattctaggccaggtatgatggctcacacctgtgttatcccagcactttgggatttacaaaatgggatttcctcctcacctaaggtcaggagttcaagaccagcctggccaagatggtgaaaccccatctctactaaaaactacaaaaattagccaggcgtggtggcagtcgcctgtaatcccagctactcaggaggctgaggtaggagaatcacttgaacccgggcggcagagtttgcagtgagccaagatctcaccactgcactccagcctgggtgacaaataaaataaaataaagaaatctgttgattctggaatatttgcgtttcattccccaatcagcaggtatccaattggcaagaagtgtgtttccccaggcattctaatgggatgccagaaggctcaacccagtgcttaaatttttagtgattacattgcttaaataatgtagacagatacaatagattcaagataaatcaatatgtaaaaagactttaaatatgtgcacaaggtatttttcaagatggataaaacatatgaatcttaaattaccatctttttttttttttccctgagacggaggtttttttcctcttgttgcccaggatggagtgcaacaacagcatcatctccactcactgcaacctctgcctcccaagttcaagcaattctcctgcctcagcctcctgaatagctgggactacaggcgtgtgccaccatgcccagctaatttttgtatattttttagtcgagatggggtttcaccatgttggccaggatggtcttgatcccttgacctcatgagccgcccacctcggcctcccaaagtgctgagattacaggtatgagccactgcgcgtggccaaattaccgtattctttcttctgtaaaaagatctggccactccagtccattacgatactgtccttttgagcctgctcaatcagtttgtttaagccctgcctcaggctaacagggctgccataagaggaatgctttccccaaaaacacatcctacaagaacagtgttgtaatctctagagttaacacttaatataaaaacacaaacttgcaggatctcgttttcatgaatttacttgaggaaagacacaaatatagagtggatgctatttattgatgcacttagtaggaaagaaggggatagcaaaagtaacaattttaccagatccatgcacatatgcagattgtattttactagagatggcacacataaaaattccagatagtggtaaggatatgaaaaaaagtggcaggaatgggtgtgatagtgaaaaagtcactgcatatctgtaccttgactgaggtcatggttacacaggtgtatacatttgtcaaaatttactgaatttaagacctatacaggccgggcgtggtggctcacgcctgtaatcccagcactttgggaggctgaggcggatgggtcacctgaggtcaggagttccagaccagcctggccaacatggtgaaaccccatctctactaaaagtacaaaaactagccaggcgtggtggcaggcatctgtaatcacagctactcagggggctgaggcaggagaatctcttgaacccgggaggcggaggttgcggtgagccatgatcgcaccattgcactccagcctgggagataagagcgagacttcacctcaaaagaaaaaaagaaaaaaaaaaaaaccaccaccacctatacatacataaattttatctcaaagaagcaccacaatagaattcaaaaacgaaatcaatttaaaaaggaaaagtacactcgattaatacaagatggaaaagaataacattataaaaccaagtatctctgcatgagcgaactccacaagaatttagtaagttatactctacattaaaaaaaaaacaaaaaacaaaaatacagaataaggaagcatttcctatacatatgaaaccacaaaatttctgtaatctttactgttaggcctctatacaaggggaagtatgtttcattttatagttccaaaaataaaatgggctctgaaaaacttcaagatagtcaaagacaggtaaccaaaatgatgacaatgtgaaaagattaacaaacagctcctctaaatcattaagggtggtccaatgaaaggagcctcagggatttgttttaggtgattaggataaggaacaagagccagataacaaaggcagaaaatcctaaagaatttaacaattcaatgttcccaaaagacaccatggaccacactccattttatatgacacttaaatgacattccatacatgtgtctaacatgaagattgagcagataaaaagtatcactttagtaatcatcctcaatcaacaccagataacaaatgaggggcttttgcttatggaaattctcacatattgagctgaacacttttaccttaattaattaattaatttatttattttttgagacagagtttcgctcctgctgcccaggctggagtgcaatggctcgatctcggctcaccacaacctccgtctcccggattcaagtgattctcctgcctcagcctcccaagtagctgggattacaggcatatgccaccacgcccggctaatttttgtatttttagtagacacggggtttctccacgttggtcaggctggtctctcccgacctcaggtgatccacccaccttggcctcccaaagtgctgggattacaggtgtgagccaccatacacagccttatcttaatttaaattgttaaatataaacataatactcaggtccttagcagccccttctctatattgttccaattaactgcctcccactgcgatctctcttgcacgtgtgtgcacgcactctaacacacacactttttttttttttagacggagtcttgctcttgttgcccaggctggagtgcaacggtgcaatctcagctcaccacaacctcggcctcctaggttccagcaattctcctgcctcagcctcccgagtagctgggaatacaggcatgcaccaccacactcggctaattttgtatttttagtagagacggggtttctccatgttggtcaggctagtctcgaactcccgacctcaggagatccacccacctcagcctcccaaactgctgggattacaggcatgagccaccatggccagcccacacactttttcaagaagcaactagatttaatcttcctaaattgtgccactttccggcaggtaaaatttcaatgattccctaaagtcactccaaatacacttaaactgggccagggtggtggctcacgcctgtaatcccagcactttgggaggccgagatgggtggatcacctgaggtcatgagttcaagacaagcctgaccaacatggtgaaaccccgtctctagtaaatacaaaaaattagccaggtgtggtggtgcgtgcctgtaatccctagagctacttgggaggctgaggaaggagaactgcttgaacccgggaggcggaggttgcagtgagccaaaatggcaccattgtgctccagcctgggcaacaagagcaaaaactctgtctccaaaaacaaacaaacaaacaaacaaaaaaacacctgaactatgattaaaggtctacaatagggttcccaacccagtgcttcagcttcacctcttatttatattactcctcataagtacccaattcctctacacactgacaatttgcacctggccttatcctaattttcttctattttgggggggattctcccccaaattcacagtgaaaactgtacagaccaattccatcaccccattttccctcctctgaccctccaagtttttgtttttgtttttgagacagtctcgctctgtcacccaaattggagtgcaatggcatgatcttggctcactgcaacctccacctcctgggttcaagcgattctcctgcctcagcctcccaagtagctgggattacaggcacccaccactgcatccagctaatttttgtatttttagtagagatggggtttcaccatgttggcctgtaaccccagcactttgggaggtcaaggcgggcagatcacctgaggttaggagtttaagaccagcctggccaacctggcgaaaccctgtcaatcatgccactgcactccagcctaagtgacagagcaagactgtctcaaaaaaaaaagaaaggaaggaaggaaggaaggtatactgagaattacatcacaaaatccacatgctctccccttcacaaagccctttacttttctcccataataacttatagcctccttgaagacagtggttttacaagtcataaaaatcctggccgtggcccagtgcagtagcttgtgcctgtaatcccagcactttgggaggccaagacaggcagatcacttgaggtcagaagttcgagaccagcctggtcgacatggcgaaaccccgtctctactaaaaatacaaaaattacccaggagtagtggcacatgcctgtaatcccagctacttgggaggctgaggcaggagaatcgcttgaacccaggaggccgaggttgcagtaagccaagattgcaccagtgcatttcagcctgggcaatacagtgagaccccatctcaaaaaaaaaaaaaaattatggccgggcacggtggctcacgcctgtaatcccagcactttgggaggccgaggcgggcggatcacaaggtcaggagatcgagaccatcctggctaacacggtgaaaccccatctctactaaaaatacaaaaaattagccaggcgtggtggcgggcacctgcaatcccagctactcgggaggctgaggcaggagaatggagtgaacccaggaggtggagctggcagtgagccgagattgcaccactgcactctagcctgggcaacagagcaacactccatcttaaaaaaaaaaaaaaaaaaaatttatacacacacacacacacacacacacatctccctagaagcatcaatatttactgaattagagtattttattacctgttataaaaaacaaacaaaaaaaccttccattatactaatttataaaggaataaaaacaaaatgggttggggagtccaggcacggtgtctcactcctgtaatcccagcactttgagaagcacaaggtgggaacttgaggtcaggagttcgagaccagcctggccaacatggcgaaacccggtctctaataaaaaattagccaggcctggtgacatgcacctgtagtcccagctactcgggaggcagaggcacgtgaatcacttgaacccaggaggtggaggttgtactgagccaagatcgtgccactgcactccagcctgggagacagagtgaaactatgtctttaaaaaaaaggcggggtgcagtggcacacacctgtaatcccagcactttgggaggccgaggcaggtggatcacctaaggtcaggagttcatgaccagcctaacatggtgaaaccccgtctctactaaatataaaaaaattagccgggtgtggtggcacatgcctgtaatctgatctacttgggaggctgagacaggaaaacagcttgtacctgggaggcggaggatgcagtgagccaagattgcaccattgcgctccagcctggacaacaagagcaaaactccgtctcaaaaaaaaaaaaaaaaaaagttggggtgaggggaaggttcaacttaaagatacgattactaactgtttcataaggaatgacttatttcatactggagtaggagtttgacaccagcatgggcaacatggggaggccccatctctacaaaaaaataaaaataaaaaattagcgtgccaagcatggtgggtcacacctgtaatccttgcactttgggaggccaaggaggaaggatcacttgagcctaggtattcaagaccagtccaggcagcatggcaaaaccccgtctctacagaaaacaacaaaaaaaaagtagctgggggtggtgacatgcacctgtggtcccagctattgggagggtgaggtaggaggacttattgagcctggaagatggaggctgcagtgagctgagatggttccactgcactccaacctgggcactggagtgagactctgtttcagaaaaagagagaggaggccaggcatggtggttcatgcctggaatcccagcactttgggaggccaaagcgggtggatcacctgaggtcagcagttcaagaccagcctggccaacatggtgaaatcccatctccactaaaaacagaaaaattagccgggcatagtggcatgcacctgtattcccagctacttggaaggctgagacaggagaatcacttgaaccaggaggtggaggttgcaagtgagctgagattgtgccactatactccagcctgggcaacaaagtaaaactctgtctcaaaaaaaaaaaaaaaaaagagagagagagagagaggaaaaataaataaattagtcaggtgtggtggtatgcacctgtggtcccagctactcaggaggctaaggcgggaggattcccagagcccaggaagtcaaggctgcagtgagcagtgattgcaccactgcactccagcctgggcaacagagcaagagcatatctcaaaaaagaggaaagaaaagaaaagaaaaacataaaaacaaacgttcctttagttttaatttttattttttagtttattatggccgttttactctcccccaagtaaaacagccatgcacaatttgctgaaattttccttagtgtactttgaaatctgtggaacagaactggcaatcgctaaattctatttgactctagttccatttaatattagactggtgtgaaagtaactgcggtttttgccaaaaccgcaattacttttgcacccacctaataagtataaaatatgtaacttcacttaattttatcctttatgtatttccctatattatgtacctatggacatcaaacttagtacagactgataaaaggctgaacagacaactctggtttcaaaaatccagcttctcacaacatcagacatactagtatacagcttttctaatttcacaacacatttccattttttggtctttcacaatagagaagatgtgtatacttttgaatactctgatctgtctacaatctaccaaaattggaaggtgtttttattatacagtttcatccttttagaaatatacaaagatcctaagtttgggcacagtaagacactcaatatagatctactactaaacaagtaagaccaagtacataattaatgtcctaacacccccagtggagaagtaaaatctacttgttttctgttgacttgaatgccttctcttctttgttgaattaatcaatctacttgactccaatgtcaaattaatcaatgtcactttagaatattaaaatgtacaattatgaattacacatttaaaacacatcattctgatctctgtcttgattgatactagaagattatcttccaaactaaggtggaaaaaatgacagactttagctattggcaatgataggtcatttttttagggaagaggagtaaagagggcaacctccataggtcagatatccctttgttctaagaagccaccacctctgtttcttcatatgaaaaaaaccagaggcatccagtggttcccaaaaccttctcaactttacgcttgaggaacccacagatttcaaataatacaactgacctaagaccactcatttgtttaaccattctttttttaattttttatttttttttttgagaaggagtcttgctctgttgcccaggctggagtgcagtggtgtgatgtcgctcactacaacctccgcctctcaggttcaagtgattctcctgcctcagcctcccgagtaactgggattacaggcatgcaccaccacatcctgctaatttatttatttttttttttttttggagagacgggggtttcaccatgtcggttggctaggctggtctcgaactcctgacctcaggtgatccaccaacctcagcctcccaaagtgctgggattacaggcgtgagccactgcccccagcctgcttaaccattcttaaatgtcgggtgcggtggctcacacctataatctcaacactttgggaggctgaaggtgggcagattgcttgagttcaggggttcaagaccagcctgggcaacgtggtgaaaaccccatctctataaaaaatacaaaaatgagccgggctgttggcaagcgcctgtagccccagctacttgtggatgctgaggcaggaggcttgagcctgggaggtcgagactgcagtaagccaagtatctgtgccgctgcactccagcctgggtgaccacagcaagaccctgtctcaaaaaaattgacagaagagttgactgagagcacagtgaatgaaaaggaagactataagccagtgccatataaatgcttactgttggaggtatgcttctatggaacacgggtttgctctcttgccatatgacattcacgtattcagccacctggaacacttcctgtctgtatgtgtgaagtatcatgtgtggtcaaaattgactcaacagtcattttccacaccaactggcaaactaacactaaaagaaatcaacaagtattgctttttcaaaagcctaaatcggctgagtgcggtgacttacacctgtaatcccagcactttgggaggccaaagcaggcggatcacctgagtcaggagtccaagaacaggccggccaacatggtggaatcccgtctctactaaaaatacaaaaattagctggacgcctgtaatcccagctactcaggaggctgaggcaggagaatttttccctgtaagcgggaggcagaggctgcagtgagtcgagattacaccactgcactccagcctgggagacagagcaagactccatctcaggaagacaaaaaaaaaagcctacatcaaggaaaacagaaccaaaacaccagggacaaaatggtacataagaggcaaaaaaaattttcaccaaaattattcagatgaaccataataaatgtgcctgcatctgaagatgttctaaaccttcatttaagcaagaagcaagatcaagatccgttccgtcagttacctggagtctgtcatctttctgaataggggacagaatcacctcaaatttaactaataaaaatttatgacttggcaaacaccccaggtatttttattgactaacaaatcagctatgacaatcttagcaacaaatcaagttatgctatggggtatgtccacactttcctgttccctctacaacaggagaaaatcaaatctttccaacatcctaacaaactgttactccctgtaaccaaatgtatcacagtatcgtctaccaaggcgttacatcctgaaactttcctacaaaaagcacagcttcaaagaaaccttgcaagctttcttgtaagctcctcccttcccacatcgcccctccccagagccaagaaataaagcacttgaaagaaacaacatggataatatttattaatagcttatgtacatattccataactacataagccatttggcttcatacctgtcagcaatgaagtcagctggccctagcacgtggctgcgactcttctctatttatttagaactacaaactacaatttacactttacaaaagctgtaggactatttgggaaggcactttattcttctaaaaggttactaaattctcttaaatacttatactgatcacaatactgaaaaataatagaaaatccattgtcattcatttaccacctgatttgttagatgccagataatcaaatttcacacatttcaataaaaaggcaaaactaagcatgtcaatcataggaagaaaaatacttaactaattttatttaaagcactcacaaactcttaagtggtacaagacaagtcaacgctgtttatcgaacaatattttttttttacgactaaacatctcaattctagactcaggcactaattattaaagtcatctagttatatacaccaattctcaacagacacagttttttttggaaaggcatattaaacagactaagatgtgtactacccattagccaaagataattttattgatttttctaatgagtcttcaaatgttacattctaacatcttagcaaattatttccaaatactgctggaattacatgtaactatcaggaaacaaaagggcttctcaacaacttgtgcgttctacattatctggccagtttccggacaattataatacaattgtgctccaaagtaggagagttccatgaatcaattgcccctaaaatatatttctgtatatttaaggagttctaagcattgggttaaattccaaacagactctgaatacaagcatttatttagtaagagaggttagaataaatcaatcctaaattaggcacagctgccctccccccattgatcaaaaagacaggaaattacatttatttaaaaagttaatgttcctaatatattcaaatctaactaagccccaaaacggtctgagatcaaatcctccataaaagaggaaattctctagacttctaagtgggtgcccaaagagttcactcaagtgtccaggtatgaattacgattcaccagagtaaccggccttgcacttagggaaaacttccatcgcccaagaccagagtgggtcgatcccatcaacagtcacacaatctcatctcatgctccactaatgaatgttctgcctaaagtcagagcaatgccttggctggagttttgttttggttttttcaatattaccacgtgggggtcacagaaagggaacagaggttacaagagctctcacgtggcggctgaaagactggggaaccgagaaagtgaatgagtaacagggagggtcctggactctcaggatctcccaactcggggtcagggggaggcggtaagtggaatgcccccccaccacccccgcctctttctcacctcctggtcccgaccctaggccagtgccaccgccgggagccccgggtctcggcttcagccccaggctgaacatgcagggaggggagaggcacttaggcctcgcctccccgtggccttcctcccccagccggggcggaggagaaccaggaagccgcgcccggctccggtgggtggagggcctaggccgcgcctcccagccccgcggccctaggcctcggcccgcccgaggcggagcccgggaggtcggggcggggtcccgggccggtcacccacctgggttgccagtcattccagctccgcgaatagttggtgccgccgctgctcagccgagaccccggggctctgcggctcattaccttccccgacacgacatggccaagcgccgccgcccagagaagcgcgagtcgccgcccgaaccggccgctgccgacaccccgctccggcccggggctgaggaggaagccgaggaggaggaagagaaggaggaggaggaggaggaggaggaggaggcggcggcggagggcggggtaagaggacggccgttccgggttccgcctgagcccgcaacgcagaatgaggaggcgggagcggcgcggtgagagagaggcggatgaaggggcgccgacttctcttccagggccatgcgcggcccacgacgccggggccccggaggacgaggacgacgaggagcaggcggtggcggcagctccccacgctcacaaggccactgcttccccgcctcccggctccgcccgccgcgccgccactgtcgcacggcatgctgggagcgagaggcggggtcggccccgccgggcctggggagagaggcgggtcctgtcggcggggcggggccgagagaggcggggccgatagcaggccgccccgccccccacggccccaggctcttggacggcgaag

SEQ ID NO: 55 - DNA, 146337 bp, Homo sapiens; identical to SEQ ID NO: 54

SEQ ID NO: 56 - DNA, 11716 bp, Homo sapiens
ttaaatataatggcaagaaaacattcctaccaattttatttatccaggcatgtcttaaatatggctgtttgttacatacagtgattctgcagacatgttgacatgacagtgaaatacataaatatgtaatgagaaaaggcttaactgtggataaaacaaagtcattacaattaaagactcgagtttttggcatttccaattgtagtcagggcactgaggtcaaatttaactacaaattttgcattgtctacattgaacacatgattcttaaaagcctcatgttttatttcagaacaggcctcaggaagttgcagactgtgcaggaggttgtttagggcacaagtcatttctcccaatattaacttataggcagtctccaaaacaggaatattcttcaagctgagcattgcttgataaacagcatgggctacagcaacaacctgaaaaacaaaaaattcaaggaagtgataaatggaaaataaatcttctaaaattatatggaaaataaatcactatctgtattagtgctgatgatacaaataaatttaagattgatcaattcactgtccgtagcacttaatattttaatttttaaaaaaccaatcagaaaactgacacagatcagtatgctatttcaaatctattaagttttatcacaaataaagagtactataaatgaaaactgtcaataggaaatttccaaaatggccgtttttttttaaataatcaacatcaaaagacatatgcaaacagcaatttaagactgggtttcttaaatctaccaggaaagtctgtggtggatttgactagggggtggttgaaaagccagtcatttttgtttacaaaatatacagtacttaatttataactttataaatgtgtcaacttgttttacccttatgaaaatttaataaatttaataacagcaagagatgcatagtctgaaaagagtatctggcacatcattcatgaaagtattcagtatgattatcaagaaatataaatttaaaagaacaaatacaatcactatattctaaatcaaacatttcacatttcactcaatttcacttatatagcctggtaagcaacattaggtccaactcttcagtgactcaagttgtcaaaattcattatcagtgtattacttacctctttttctttatgataacgcaagaatagtagtttagatgatggtataaacagtttttctacaaatgatgatggcagtttcgtatttatctgttcaacaatctaaaagaataaaatttttaaaaaatgagcttctcaaattacaaaaagacatggagaaaccttaaatgcacactggtaagtgaaagaagtcaattgaaaaggctacatactatatgactccaactacatggcattctggaaaaggcaaaacgatggagacagtaaaaagatcaggggttgccatgggcttaagatggagggagggaggagtgaggagagggaacgaggaaggagtgggtagaacatcaaagatttttagggaagtgaaactatcctgtatgatactggtaataggggatacatgtcattacacatgttaaagtccatagaatacataacacaaagtaaactataaaattagttaataataatatatcaatattcactcctttgtaataaatgtaccacactaacacaatatgttaatgagggggaaactgttgggatgaagaaggtatatgggaactcattgttttctgctcaattttctgtatatctaaaaaataaagtcttttaatttagaaaaatatatctaagctatattttaaggccttaatactgtgacattaaagtgtttagacacctaaataggacacacgtattttacagttatcatgggcattttttcacattagcaaagagaggtgtaattctggcagaaatgctcagcagaatgtcatctagaatttgctttaaaataatccagctggagatgaaaggatagcaaagaggcctagatgaaaccagatgggccatttgtttctaattatagaagctgagtgttaaatatgtacaaatttattatactatgctccctatttttatgtgcttcagaatgtccataataaaagtggggggaggatatttatggttaagaaattaaaggaggccggccgggcgtggtggctcacgcctgtaatcccagcactttgggaggccaaggcaggcagatcacgaggtcaggagatcgagaccatcctggctaacatggtgaaaccccgtctctactaaaaatacaattgtgccactgcactccagcctgggcaaaagagcgagactccgtctcaaaaaaaaaaaaaaaaaaaaaaaaagaaattaaaggaggccaggcatgattgctcacacctgtaatcccagcacttcgggagggcaaggcaggaggattacttgagaccaagaatttaaggccagtctagacaatgtagtgagaccccttctctccaaaaactacaaaggttagccaggcatggtggcatgcatctgtagtcccagatagtcgggaggctgagtgggagaatcacttgagcccaggagtttgaggctgcagtgagctctgattgtaccgctgcactccagccaggggaatacagcaagatcctgtgacaaaaaaaaaaaaaaaaagaaaaaagaaaaaaagaaagaaaagaaaagaaaagaaaagcaaaaaagaaagaatctggtgcgtagagcaatgtttcctcagaaaaaacgagtaaagctacactgagactagctatcaaccactaaaaatagaggcctggcagagtggctcatgcctataatcccagtactttgggaggccaaggcaggtggattgcttgagcccaagaattcaagaccagcctgggcaacatggcaaaactccatctctacaaaataatataaaaaattagccaggtgtggtggtgcacgcctgtagtcctagctacctggggggctgaggtgggagggtcacctgaacccaagaggtcaaggctacagtgagccaaaatcatgccactgcacttcatcctgtgcaacagagtgagaccctgtctcaaaaaaaaattgcattaaaaataaaagtaaatagacactaaaatgaaagcatagattataagactgatgaatgtactctaaaaaataatataataaagcaaagcccttattttttttcttttttggagacagggccttttttgtcaccttggctgagtgcagtggcacaatcagagctcacttcaacctcaagttcctgggcttaatcgatcttcctccctcagcctcccgagtagctaggactgcaggtgcacaccactacaccaagctaatttttgactttttgtacagatggggtctcactacattgcccaagctgtgccagaattcctggatgcaagcaatccttctgctttggcctcccaaagtgctgggattacaagcatgagccaccatacccagacaaagtccttaatttcttacatatcgatttaagggcctgaataaaccaacacattaaaaaggaaaagaataattcacataccagcgtgagtaaattcaagactgagatgatataatcggtaccacaagtctggcaattctccagttggtctaatccatatgtaatgaccatgtcacaatgtatagtcatgctaggatccaagctgccgagcaaaacaccaacacactcattagcagctgtcaacacagcctcagaaaaaaacacctggtttgcagccgtcacacatctcattactctgtacagaacctgtaaatggggaaaacaagcagctttttacaaaaattcacgtgcttccacaaagcaagaaaatactttttatttaatgcaatttcaactgaaaattaactgcttgccttgccagcagtctcttaatattctagttctcagtagctgaataataatgatccctttactacaatatgtaaacatgatcttggctaaaaaatcctaaagtgctactatgacaggaaatggaacctgccatcctctatttcccatatacccaacttcgtttctcccaatgtcactaaatggctgaagctcagaatctttatcatgaaatacaccacgacagtaatggtattgacagcatgggaatagcctgcccacacatactacaagctagctcttgggcttttgggaatcaatctttcaaaactgaacatacaagtcactttaagcttattaaagtttctatctactgatggtctcttttgaaagataagcactctcatgcttaccacataatatcttcaaaaatcatattatttccaatacacacacaaacaaaatcccccacttaactataatggccaataattgtgtactaaatttctaataaaatgggggagaaaacagagcaaatgtttaaaaatatttctataatatttaacaaccaatacatacaggattttatttagtctacccatagttttcattaaaagtatccttggaggttgggcatagtgactcacatctatcatcctagcactttgagaggattagctggaaggttctcttgagtccaggagtttgagaccagccatgtcaacataacaacacctcatctctaccaaatttgtttttaaattagttgggcgtggtggctcacaccagtagtcccaccaactacttgaggctgaggtgggaggatcacttaagcctgggaggtcaaggctgcagtgagccaagatcgtgccactgcactccagcctgggcaacagagaccatgtctccaaaaaaaaaaagagtgggggagagagggcggagggggaaccattcttggccatgcatgcacagtggctcatgtctataatcccaacactttgggaggctgaggtgggaagactgcttgaggccaaaagttcaagaccagcctgggaaacactgagaccccatctctacaaaaataaaaaattagcaggaactatggtgggaggatcacttgagcccaagatacagaggctgcactgagtcgtgatggcaccaccccactttaaaaagaaaaacaaaaaaagctgggtatggtgacacccgcttgtagggctgagtgaatgggaagttcacctgggcccaagagttcaagactacagtgagctatgattgcactactacactccagcctgggtgacagagtgaggctccagctccaaaaataaataaaaaaaataaaaaccccaccattctaccattctcaaaggcctaaaagatcctcataaatcaatatacacctatcctataaattatgtcccttttattttatgtctgaattaacggctttttatttcaactctgtacagtcttcaaccaccttttagacattaaaaatgaagcaaagatattaaaccattttgaaaccatattggtttaaaataccaatatgctggtttcatttatctttaagttctgacatttctgctcaagtacacaacttactatataatcaatatcctattttatttagcaacatgttcagcaaaagtatatgctcctaaaagcgagttttatcctaacagtaaaattttcatcagttagattaatttttttatgactgtatcacacatgcttctttctccttattcaaagcagagtacaatgcctggggttcatttcttgtgtcttttccactgaaccctcattggatgtgctatatacagtgcagctaatgtttgaggctgctgaagtgtggcaatctagctacctcatttttaatttgtttatgttctttgatatcaggctatcaaagaatataaagatatacaagttttcatatgagttccatcttatgctcagagaaggttactttctgaggcttctcctatagtgtgctattcgtaatatgttgaaaaactaaaaggaaacccaataatttaaaagtaaaattataagaaatattatttcttataataataccggcgcaggagggcagcaccagaggccagtggcactcccagctcggtgagagggctgggaagccagggaataaaactgggagggtggggtggggctggtgtttggggcacctcaaactcacaacattgggaatctttgtgggtccgggaatggtaatcctgaggcctcagaacacaggtttcagattgataggcctgcaggtctccaggcagcaaccagctgagcgactaaagggcccaaggccagggctctagggatggggctcagcagaggctggggtaaggggagccagggaggagctgggcctaatgcagcaccgggtccccaggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatggcagagaaaaaaatcataataaaatggctttattttctggtacctcccagactctgatgactggtcccctagacacgcagtttgctgaaccaaccagccctagagcttcccctccaccgcgctgaggggactgacccatggcaggggatgtgggatgccccctgacttactacatcacaggaacagggccttcgtgggtagaaaccagccatgctgatgtgggccaggaggctgctctccgtttccgagctccttctcagagctgacacagctgaactatttaaggccctagcttagaacctcaataattcccaaatttaccaaaaatctgcctttcctagtcaaccaaaacatcacgttgcacgtgactctgctggcactgttgcttgtgaggaaatgaaccaaccatcacttacagggtaggcatcttttaaactgcaggtccaaagataaaaataacgagggaggctgggcatggggactcacgtctataatcccagcactgtgggaggctgaggcggcaggatcatttgagcccaggagtttgagacctgcctgagcaacacggcgagataccgtctctacgaaaaataaaataaaaaattagccaggcatggtggtgggcacctatagttccagctactcaggaggctgaggcaggaggatcccttgagcccaggaggtcgaggctgcaatgagccattgcaccactgcactgcagcctgggtgacagagcaagacactgtctctaaaaaatataaataggccgggtgtggcagctcacgcctgtaatcccagcactttaggaggccgaggtgggtgaatcacctgaggtcagaagttcgagaccagcctggccaacatggtgaaaccccatctctactaaaaatacaaaaattagctgggcatggtggcaggcgcctgtaatctcagctactcaggaggctgaggcaagagaattgcttgaatccgggaggcaaaggttgcagtgagccgagatcatgccattgtactccagcctgggggacaggagtgagacttcgtctcaaaaaaaaaaaaaaaaaaaatatatatatatatatatttttttttttttaaatgtataaatacatcatatatattttaatatataaatatattatatatattatatattttaatatataaatatattatatataatatattttaatatataaatattatatatattatattttaatatataaatattatatatattaattatatattttaatatataatatatattatattatataataataaattatatattatattatatagtaataagttatatattatactatataataatatagtataatatataatatatattataatatattatattatattatattatatattataatataaattatatatattttatatatatgttttatatattatatattttaatatatgaaacaggggaacttcttctaaggaaaagacagaattaaggcaacaggctgatcctagtttaccagagaagaaactgaggccgggagcaggagcccagctcactgaagggcagatcccaagtcagagtccaagtctccccacttttttatttatttaattttttctgagatggagtttcattcttgttgcccaaattgagtacaatggcacaatctcggctcaccgcaacctctgccttctgggttcaagccattctcgtgcctcagactcccaagtagctgggattacaggcatgtgccaccacgtccggctaacttttgtgttttcagtagaggtggggtctcaccatgttggccagactggtctcaaactcctggcctcaagtcatctgcctgcctcagcctcccaaagtgctgggattacaggcatgagccgctgtgcctggccttatgtctccccttttgaattcagagccttcccccgtgtagtgagtgcttctgcctctctagcccttcctgtgggttctgcctgggcctgacctctgtgagagacctggcaggaacaggtctgtcaggccttgtggggagtgggtgtgggaataggttttgatacccaacttagcaggtgatcctgagatgggaggacacagggctgtttgggatgggcgtcttagccatagtaaggtttggttcatatcaagcagggaccacccatggcgtcatttccaggccccacctcttcagtatgccatagaaaactacttgggcagtagaggtgtgggaagaaaacaaaaaagaaagctgggcataagtggcacacgcctgtaatcccagcacttttggaggccgaggcgggtggatcacctgaggtcgggagttcaagaccagcctgaacaacatggagaaaccctgtctctattaaaaatacaagattagccgggcgtggtagcacatacctgtaatcccagctacttgggaggctgagacaagagaatcgcttgaacccaggaggcggaggttgtggtgagccgagatcgtgccattgcactccagcctgggcaacaagagtgaaactctgtctcaaaaacagacaaacaaacaaacaataaaaaaaccccaaaaattagctgggcatggtggcgtgtgcctgtaatcccagctactagggaggctgaggcaggagaatcgcttgaacccgggagggggaagttgtagtgagccaagatcatgctactgcactccagcctgggcaacagagccaagactctgtctcaaaacaaacaaacaaacaaacaaaaaaacgcaggaaaagagtgtgtgatggctgaaacttgcaatttctcactctcaacgagccctggccccaactaggttatttgggctccctccctaggtctcagggacctctgttcaaagtcctagcaatctgggccaggtacaatggctcacgcctaaaattccagcactttaggagaccaaggcgggcagatcacttgaggccaggagtttgagactggcctggccaacatggtgaaaccctgtctctactaaaagtacaaaaattagccgggcatggtggtgcacccctgtaatcccagctactcaggaggctgaagcacaagaatcttttgaacctgggaggcagaggttgcaatgagctgagatggcgccacggcactccagcctgggcgacagagcaagaccctgtctcaaacaacaaaaaacaaataaaacaaacaaggtcctagcaaccctactaacctgttatgaagactgatacaggggcatcacctgccccaattttctgactcaggtcagccttatattcctactctaatctcacccctatccccgtcccacacccactattcttaaaacctccatggtcctccgggggcagctgtagacacattaagcccagggctatggggccactggaaccttctccagtgggtctgaaaacatcagcattccaggagttgatgagcccctacctgggcaccactccctcttgggcctgagaaggccggggggaacctgcaaggaatatgtggaattctatatggtgcctctgatactgcggtaatgtcagggagaggtttgttcaactggtcagggccctgaaaccccgatcactttctcatctctgcatcttgaaggctagcagagaggaggaaccctgagctctctaggaggtgggtaggtggtggcagtacagactcctagatgtctaaacggagttgcagagagaaggctttctcggtagaccctggaagggacttttacggtagaactttcattttacaagcagggatagaggcctagatggggacagagacgtgtccaaggtaaaacaatggacggaggcagggcagggagaggccaggtcctagactcggcctcagcacccctcccacacacacatcgacacagaagctggtccagatttataatttaatggctgtgcagatcccagtccctcatttctgtcgctcacgtgcccactggtctggggtcagggttttctgttcaaaggcatggatgtgcgggagctcttctgctaggcacgcgttcaccagcctggggcgagagatggggttaggaaaaggccagcggtgatcgcacaccccgaggctagggtgacccaagagactggtgtccccaaggttgtagtccccaggccgtgggaacacgtacttggagagagggtctacatcgaaatactcgaagcaggggtcacgaaggcgggatcctcaaggtccctgagccacgccagggggagtgcgggagtcaggttgcaggggtagggggagtggctggggttgtggtacaggagctaggcaaggtgctcccagggccttacctgtgtctctgaagcagcggtttcccctcgaacttggccgacaccaccaggactcggaagctacaggagcaacggttgagggtcgtgtcctccacctcctaccgagcggaagaatatgaatggtgccgaacccgccccccgagctcttttccccttgtccggcggctcaactcaccacatgctccgcctccaggtcccgctgcagcttctcgcggaggtattcggcgctgagttccatggcggcagtccagctggaacggcagcccagcagggacacaaccccagctcgggcgccggccacgctaccttgctgccttacaggagccacttccgctggaaaactcacttccgcccttactaaggcgtacgtcaacgcagtacttccgccctcaagcagccgggctttccagcggtccaggcttttcgcgcttgccatgtgtcagccaatcagagcctgaggaaggtgggactcgggcggagccgatgctgaatggtacgcgctcgccgactggacagcagtctggcttccgcggtcggacttctacacccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctggtgagagggggaggccttctgtgccgggaggaag

SEQ ID NO: 57 - DNA, 3666 bp, Homo sapiens
cttctacacccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctggtgagagggggaggccttctgtgccgggaggaaggcgtcccagaggaggcggaccccgcggggcacaggcctgttgagaaggaccggccaggactgtgacagaggcggggcgtctgtggtggggacggggcctgtcgcaggggaggagcgtgacggggaggcggtgcccggggcatctccgcggcggaactcagggaaggagctagctggggcgggggtgatgatccaggctgggttccagcatagggctcttggtgggcacgctggggtcgggtggaatgcaggagagagaggaggtgggacaggtgggtacctgggctggaggcagggcctgaggtgggcaggtgcagagggctgcacttctcggctgaagccgggaatgaggaccccgctctcgggtgggattggaggggacccgcggctgaggcgctgggctgcgacagggacatcaccgttctcctcctcagggagatggtgctcgtcgtgcacggcttcccgtcctccgtggccgcccttcgggtaaggaaggagaccgggcagcggcggccgggtgagggcttgggttccgcccctcgctccgagccgccctgatgcccctgtacgccgcccgcagtttgagtgggcttggcagcacccgcacgcctcgcgccgcctggcgcacgtggggcctcgcctgcgaggagagacagccttcgctttccacctgcgcgtgctggcgcacatgctgcgcgcaccgccctgggctcgcctcccgctcacgctgcgctgggtgcgcccagacctccgccaggacctctgcctcccgccgccgccgcacgtgcctctggccttcgggcctccaccgccccaggccccggccccaaggcgccgcgcaggtccctttgatgacgcggagcctgagccagaccagggggatccaggggcctgctgctccctgtgcgcccagaccatccaggtgaggtccccccgaggaatggatggctctagagtccagacgacttcggatccagctctttcttgagggaaacccactgacacgctttggccaccctatccccatctctaagatgctgatgctataggacttacggccattcctgagcaaagcaggccctgctcagggccttcaccatttccccttcaaagaaaaggttcttccctaggccatcagtactccgctgcactccagtgtggtcgacagagcatgaccctcttttttttttttttttttttgagatggagtctagctctgtcgcccaggctagagtgcagtggcgcgatctctgctcactgcaagctccgcctcctgggttcacgccattctcctgcctcagcctcccgagtagctgggactacaggcgcccgccaccacgcctggttaattttttgtatttttagtagagacggggtttcaccgtgttagccaggatggtctcgatgtcctagcctcgtgatccgcccgcctcagcctcccaaagtgctgggattacaggcatgagccaccgcgcccggccctttttttttttttagacagagtcttgctctgttgcggaggctggagtgcagtgatctcagctcactggaagctccgcctcctgggttcaagcgattctcctatctcaacctcccaagtgtgccaccacacctgccgaatgtttgtgtttttagtagggatggggttcgccatgttgggcaggctggtctcaaactcctgacctcaagtgatctgcccgcctcggcctcccagagtgctgggattataggcgtgagccaccatgcctggacatgaccctgtctctaaaacaatgtaatgaactgcagctcattcttgtgtgcacttttctgcaccccctttcccttaacacttactattgtctggcatgctacgtgttttcttgatctcattagcctctcccaccccaactgccacactgcactatcagagggcagcacttatcactgctgtagaacaaagtcctgcactgagccgatggcccagaaattttctttttatttatttatttattttttttttgagacagagtcttactctgtcgctcaggctggagtgtagtggcgcgatctcagctcactgcaacctctgcctcctggtttcaagcaattctccttcctcagcctccagagtagctgggattacacgcgcctgccaccgcgcctggctaatttttgtatttttagtagagatggggtttcaaccatgttggccaggctggtctcaaactcctgacctcaggtgatcctgcccacctaagcctcccaaaatgctggtattacaggcatgagccaccgtgcccggcctaaatatttaataaaataatggacgatgggtgccttctactgagctcccggtaattgtgagtgagtagaggacttgccctggggacattcagtgacctgctgggtgttgctgagctgtgaggaagttcaggtctggctgcagtggtgaggctgtgactcaatcaatcactgctgatgctcccaggacctgcaccagcttagtcctaggggcaaggattttaactgtccacctcagtttcttcatttgtaagatgcaaataacagtcacccctgcctcatgggatggagctgtgtaatgcccgcaacagtgcctgctgcatagaggggttgctgccagctgcctctccctccttgtctcttacctgcctgctgcctgggtcaggatgaagaggggcccttgtgttgcccccaccctggctgcctgctaagggcccatgtgatctgcctggcagaggagtttcttcaggaagaaccagggcagcttctgcccctagagggccaatgcccttggtgagtgcagtcccctggccccagcctggtccacctctgggaagagggtgcccagttgtgcaatccaggcccaggcagctgagccctcatctcagcatgcagggcggatactggagggggcttgtggcatctgactctgtatctcctacctgcccctctccttggtagctgtgagaagtcactgctttggggagacctgatctggctgtgccagatggacactgagaaagaagtagaagactcagaattagaagaggtgagtgggctttggtggcgggctccctaccccactccctgccctgggctgcctgtgaccacactgcttgcctctgcaggcacactggacagacctgctggagacctgatcctcagtgtccttaccccctcctacctcttttctgtgccacctgctgtgggtccagcaggtttttacttgagtacaataaaaagtctgagtcaa

SEQ ID NO: 58 - DNA, 9908 bp, Homo sapiens
gtgacggggaggcggtgcccggggcatctccgcggcggaactcagggaaggagctagctggggcgggggtgatgatccaggctgggttccagcatagggctcttggtgggcacgctggggtcgggtggaatgcaggagagagaggaggtgggacaggtgggtacctgggctggaggcagggcctgaggtgggcaggtgcagagggctgcacttctcggctgaagccgggaatgaggaccccgctctcgggtgggattggaggggacccgcggctgaggcgctgggctgcgacagggacatcaccgttctcctcctcagggagatggtgctcgtcgtgcacggcttcccgtcctccgtggccgcccttcgggtaaggaaggagaccgggcagcggcggccgggtgagggcttgggttccgcccctcgctccgagccgccctgatgcccctgtacgccgcccgcagtttgagtgggcttggcagcacccgcacgcctcgcgccgcctggcgcacgtggggcctcgcctgcgaggagagacagccttcgctttccacctgcgcgtgctggcgcacatgctgcgcgcaccgccctgggctcgcctcccgctcacgctgcgctgggtgcgcccagacctccgccaggacctctgcctcccgccgccgccgcacgtgcctctggccttcgggcctccaccgccccaggccccggccccaaggcgccgcgcaggtccctttgatgacgcggagcctgagccagaccagggggatccaggggcctgctgctccctgtgcgcccagaccatccaggtgaggtccccccgaggaatggatggctctagagtccagacgacttcggatccagctctttcttgagggaaacccactgacacgctttggccaccctatccccatctctaagatgctgatgctataggacttacggccattcctgagcaaagcaggccctgctcagggccttcaccatttccccttcaaagaaaaggttcttccctaggccatcagtactccgctgcactccagtgtggtcgacagagcatgaccctcttttttttttttttttttttgagatggagtctagctctgtcgcccaggctagagtgcagtggcgcgatctctgctcactgcaagctccgcctcctgggttcacgccattctcctgcctcagcctcccgagtagctgggactacaggcgcccgccaccacgcctggttaattttttgtatttttagtagagacggggtttcaccgtgttagccaggatggtctcgatgtcctagcctcgtgatccgcccgcctcagcctcccaaagtgctgggattacaggcatgagccaccgcgcccggccctttttttttttttagacagagtcttgctctgttgcggaggctggagtgcagtgatctcagctcactggaagctccgcctcctgggttcaagcgattctcctatctcaacctcccaagtgtgccaccacacctgccgaatgtttgtgtttttagtagggatggggttcgccatgttgggcaggctggtctcaaactcctgacctcaagtgatctgcccgcctcggcctcccagagtgctgggattataggcgtgagccaccatgcctggacatgaccctgtctctaaaacaatgtaatgaactgcagctcattcttgtgtgcacttttctgcaccccctttcccttaacacttactattgtctggcatgctacgtgttttcttgatctcattagcctctcccaccccaactgccacactgcactatcagagggcagcacttatcactgctgtagaacaaagtcctgcactgagccgatggcccagaaattttctttttatttatttatttattttttttttgagacagagtcttactctgtcgctcaggctggagtgtagtggcgcgatctcagctcactgcaacctctgcctcctggtttcaagcaattctccttcctcagcctccagagtagctgggattacacgcgcctgccaccgcgcctggctaatttttgtatttttagtagagatggggtttcaaccatgttggccaggctggtctcaaactcctgacctcaggtgatcctgcccacctaagcctcccaaaatgctggtattacaggcatgagccaccgtgcccggcctaaatatttaataaaataatggacgatgggtgccttctactgagctcccggtaattgtgagtgagtagaggacttgccctggggacattcagtgacctgctgggtgttgctgagctgtgaggaagttcaggtctggctgcagtggtgaggctgtgactcaatcaatcactgctgatgctcccaggacctgcaccagcttagtcctaggggcaaggattttaactgtccacctcagtttcttcatttgtaagatgcaaataacagtcacccctgcctcatgggatggagctgtgtaatgcccgcaacagtgcctgctgcatagaggggttgctgccagctgcctctccctccttgtctcttacctgcctgctgcctgggtcaggatgaagaggggcccttgtgttgcccccaccctggctgcctgctaagggcccatgtgatctgcctggcagaggagtttcttcaggaagaaccagggcagcttctgcccctagagggccaatgcccttggtgagtgcagtcccctggccccagcctggtccacctctgggaagagggtgcccagttgtgcaatccaggcccaggcagctgagccctcatctcagcatgcagggcggatactggagggggcttgtggcatctgactctgtatctcctacctgcccctctccttggtagctgtgagaagtcactgctttggggagacctgatctggctgtgccagatggacactgagaaagaagtagaagactcagaattagaagaggtgagtgggctttggtggcgggctccctaccccactccctgccctgggctgcctgtgaccacactgcttgcctctgcaggcacactggacagacctgctggagacctgatcctcagtgtccttaccccctcctacctcttttctgtgccacctgctgtgggtccagcaggtttttacttgagtacaataaaaagtctgagtcaagggtgccttatggtggatgctgaggggaggggcggagctagtagcccaaggtcctgccagtcacggggcttcctcaggggcacagaggaggcaggaggggcccctggccctagcacgtgaacagcttctactctgcctggaaaccccatgcctcagctttcccctacttgcctctgagctcatgcaattcttggaagcctgggagacttaccttgaaattgaatgcaaataggacaaagaccaaggaggatggggggatgccctccttccacggggccctgtggcttccaagtcttaatctcctctagtctcttgtctacggagcctccttcaaacccagggaaagaaaatcacctgccagggttgtttttcttctaggatcttctattgatgctctgtgaggtcccccaggagccatgaagctagggctggctcctagggcaatgggactacagtgtccttgtcctttcttattctttctgttctttctttctttctttttttttttttttttttttttttgagacagagtctcactctgttgcccaggctggagtgcagtggtgtgatcttggctcactgaaacctccgcctcctgggttcaagtgattctcttgcctcagcctcctgagtagctaggattacagatgcccgccatcatgcccagctaatttttgtatttttagtagagacagggtttcaccatgttggccagcttggtctcgaactcctgacctcaggtgatcctgctgcatcgacctcccaaagtactgggattacaggcgtgagccaccacgctcagcctctttcttgttctatatgtccatgctctgctccacttctgccccttcactctgcccccacacatcactccagactggccttgtggtcagagcctggaatgcctgggctgctgggggcctgtggactgcactgggccagaacccctgccgccttcaagactggcctgtagccagcaggtaggtgacttttcccaggccggcctatcccacctttcccctccactcactcacctcccttgcctgggtcaattagagaaagcttgtcggccaggcatggtggctcatgcctgtaatctcagcactttgggaggccgaggcgggcggatcatctgagctcaggagtttgagaccagcctggccaacatggcaaaaccccgtctctactaaaaatacaaaaattaaccggatgtggtggtgtgcacctgtaatcccagctactcgggaggctgaggcagaagaatcgcttgaacccaggagggggaggttacagtgagcggagatcgtgctactgcattgcagcctgggcgagagagcgagtctccatctcatataaaaaaaagaaaaagaaagaaagaaagcttgtctgttggcctgccctgcagggtggagttcagagggaaggtcaggagcctagtgacagctcaaaaaaaaaaaaacccaaataccaatgttggccccttttgcctttcattcatgtgttttctatacactaaactcacatattgggtttgcagatcactccaagcttggctggagctgtggtggtaaggagggtaatagagaagcttccccaccctcaaccccaccccttccttcctggagttcccagccctgactttagatccctcccacactggaccttcaaaaccctcagggcagagagcagccctacactccctacaccacacccatactcagcccctgcaggcaaggagagaacaggtcaggttcccgagagctcaggtgagtgacacgttggaatggcccagggcaccttcaccctgctcagcttgtggctccaacattctagaagccgaggcctctgccatccctgccctttcccatggatattccatttcaattagacaacccagcctggccggaatccccctgcgttccttcttttcctttgtgtatttttgagacagggtgttgctccgtcacccaggctggagtgtagtgggatcctggcccactgcagcctcaaattcctaggctgaggcaatcctgccgcctcagcctcctgagtagctggggttacaagagcaagccaccacacccagctaattttgaaaaatattttttgtagaggagaggtcttgctttgttgtccaggttggtctcaaactccagggctcaagggatcctttcccgttggcctcccaaggctctgggattacaggcgggagtcaccctgcctgggcccctccttttgatgagtcatcagttttcattcccgcacgaggctctagcccctggtaccagcttagttgctcaatgggctgtgtttgttctggagcccagatggactgtggccaggcaagtggatcacagacctggccggcctgggaggtttccacatgtgaggggcatgaggggggctcaaggaggggagcatcggggagaggagcgcactgggtggaggctgggggtcccagcaggaaatggtgagacaaagggcgctggctggcagggagacagcacaggcaggccctagagcttcctcagcacagctggactctcctggagaccttcacacaccctgatatctgggccccgcgctacgagggtgctttcactggtctgcactatgccccaggccctgggattttgaacagctctgcaggtgactgaaaggtgcggccaggctggggaacgacctggtttcagccccagccccgccactgactgactttgtgagtgcgggcaagtcactcagcctccctaggcctcagtgacttccctgaaagcaaaaactctgcaaaggggcagctgggtgctggctcacacctgtaatcccagcactttgggaggctgaggtagacaaatcacttgaggccaggagttctagaccagcctggccaacatggtgaaaccccatctctactaaagaaaaaaaaaaattagctgagcatggttgtacatgcttgtaatcccagctacttgggatgccgaggcgggaggattgcttgaacccaagaggtggagtttgcagtgagctgagattgtgccacactgcactccagcttgggtgagagtgagactccatctcaaaaaaaaaaaaaaaaaagagagaatcccactttcttgctgttgtgatggtggtaagggaacgggcctggctctggcccctgatgcaggaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggtaagtgaggagggccacccaccctctcccaggcggcagtccccaccttggtcagcaaggtcgtgccctcagcctgctcacctcctatctccctccctctccaggcaccacctgggtgagccagatactggacatgatctaccagggcggcgacctagagaagtgtaaccgggctcccatctacgtacgggtgcccttccttgaggtcaatgatccaggggaaccctcaggtgcatggctgggtcctgggggtaagggaagtggaggaagacagggctggggcttcagctcaccagaccttccctgacccactactcagggctggagactctgaaagacacaccgcccccacggctcatcaagtcacacctgcccctggctctgctccctcagactctgttggatcagaaggtcaaggtgaggccgggctcaatggttcacacctgtcatcccagtttgagactgaggagggaggatcccttgaaggcgagagatggagaccagcctgggcaacattgctgtagagatgacatcccatctctacaaaaataaaattaacaacctggtatggtggcatagactgttcccagttacttaggaggctcagcggggaggactgtttatgcaaataggaagctgcaatgagccctgatgatcctgctgctgcactccagcctgggcaacacagcaaaaccatctctacgaaaaaaaaagttcccactgactggcaaggaaagccaggaaggggggctcaggtgccctctcagccatgtacctgttcttctggaagggcctcctcgcttctgccaggctcatcacatctttttttttttttgagacagagtcttgctctgtcaccctggctggagtgcagtggcatgatctcagctcactgcaacctccgcctccccagttcaagtgattctcctgcctcagcctcctgagtagctgggattacaggcgtgtgctaccacacccggctaatttttgtattctttttagtagagacggggtttcaccatgttggtcaagtggatctcaaactcttgaccttgtgatcctcctgcctcgacctcacaaagtgctggaattacaggcgtgagccaccgcgcctggccctttttttttttgagacagtttcactcttgttgccgaggctagagcgcaatcgtgtgatctcggttcactgcaaccaccgcctcctgggttcaagcaattctcctgcttcagcctcccaaggagctgggattacaggtacctgccaccacgcccggctaattttgtatttttagtagagatggggtttcaccatgttggtcaggctggtcttgaactcctgacctcaggtgatctggccaccttggcctcccaaagtgccgggattagaggcatgagccaccacgcccagccttcatcacatcttgagagaggacactgtctgcctcttgctctgatgagggtctgatgcaaggatagtgagtctctacagtgcacacttaagaaaggcagcatgtgggtgctcacaggtcagcggaggagggggagctggtggggaccaggcatgccttgctccagatcaggatatgatggcattggtgcagattatattagtatagaatatggtctcaggaaccaggcaggactttggcttccgagcagggttcagatcccagcttggccctacctgtgcagtgagatctcaagcaagtcagcctctaagcctcaggttcctcctttgccagttcaacagatgagctggcctggggtgggctgtgtggtgatggtgctggggctgggtcctctgcccctgcaggtggtctatgttgcccgaaacccaaaggacgtggcggtctcctactaccatttccaccgtatggaaaaggcgcaccctgagcctgggacctgggacagcttcctggaaaagttcatggctggagaaggtgggcttgactggaggaaggagggtgtgaagccgaggggtggtggctataacgtacagcaaccctgtgtcggtgccccctgcccgcttctctagtgtcctacgggtcctggtaccagcacgtgcaggagtggtgggagctgagccgcacccaccctgttctctacctcttctatgaagacatgaaggaggtgagaccgactgtgatgcttccccccatgtgacacctgggggcaggcacctcacagggacccaccaaggccacccagccccgtccctgggcggctcccacagcaagcccggattccccatcctacctccctggcccaggcccccccactgcagccccacctggcagcaggctcggcacagctttcatcttctgcacctgagtcagctgcatgggtggccacggatcagatacttagtcctattgcttatcctcaccaaagggtgtgccacccagggccacagtcatggaagaagaccatcccggtcctcacccataggcgccaagccctgttcatgatgggatcacagggcagagatcaattcattttactccagagactagggccccaggggttgaggctctttggggtttctaggggaagtggccagatcccctctgaggttagagagggggacccgttttgttttgctccactgaggagccctctgctgctcagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggtgggtgctggccagcacgggggtttggggcgggtgggagcagcagctgcagcctccccataggcacttggggcctcccctgggatgagactccagctttgctccctgccttcctcccccaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggcacagtggctcatgtctgcaatcccagcgatttgggaggttgagctggtaggatcacaataggccacgaatttgagaccagcctggtaaaatagtgagacctcatctctacaaagatgtaaaaaaattagccacatgtgctggcacttacctgtagtcccagctacttgggaagcagaggctggaggatcatttcagcccaggaggttgtggatacagtgagttatgacatgcccattcactacagcctggatgacaagcaagaccctccctccaaagaaaataaagctcaattaaaataaaatatgatttgtgttcatgta

SEQ ID NO: 59 - DNA, 18875 bp, Homo sapiens
tcccacccccagcctggggcctctgggagccttggtcctgagcagccaacacaccagcccagacagctgcaagtcaccatggacgctgaaggtaaagggacactctctctgccatgtccctgcacccatccccccactgcctacccctgcccccaccctggcttgtctcagccccttgttgcctcctctggagtcatctctcctctggtcccgccatcgactcccttacctaccccatgtccctgcagccttgctcaacccccagaggccccttctcactcttctttctcctgtgttgagtccccaaggagctctggggaaggaaggggcttaagccctagaaaagggcagggtggcctggaggaggtggcgtctcctgggggcagtgggggccggaagtgggaggctggttgggggagcagcatggacttctgctctcgctggtagctcgggagaagcagagacaaagtcctgtcccttctgcagctgggtgggggagggggcttgagtcccgtgattccctgcctggagggagctgtatgcaaactgttggggtgatcagtcccaacccccaaccatgaagtccggtggcaacaaaggaatgagaaaagacaagttaagatttaaagcagccccagggggccagttgctaaagtgaaggctgcagagccctggttgcctgataatttattgagtacaatcttttgatctaagaagcagatggtacggggtgaaacggtgaaggtgggggtgtgcgcgtcatttgaaagatgtatagccgtggtggtttatgtgaatttcctttaagctcaaagcatatgtctaactactaagataatcttttttttttttttttttgagacggagtctcgctttcccccaggctggagtgcagtggcgtgatctcggctcactgcaagctccgcctcccgggttcatgccattctcctgcctcagcctcccgagtagctgggactacaggcgcccgccgccacgcctggctaattttttgtatttttagtagagacggggtttcaccatgttagccaggatggtctcatttcccaacctcgtgatccgcccgtctctgcctcccaaagtgctgggattacaggtgttagccaccgtgcccggccaactaagataatctttaacttattgggctgcagctggtgggagtgggttttacaaggagccaggatgtctggtcacattccaacgcttcaaggaagtgtttcagcccagagcattctgtgtaaagccgcagagcaggtcatgttcactggcctggggacacaatggcaataaggaggtgattctcctcagaggccccctatggtgttccataggtgtcctacacaggggtggctgactaaactggcgccccgtaaacccttccaccagcacaaacccaggggtccatgctctacgctcagaaggctccaccagggatggggctgtgtgaccatgggtgggtcctggcttctcagagtcccgttttcttccatctgtaaaatgacaataatagttccctgctctggcccgccacggtggctcacgcctgtaatcccagcactttgggaggctgaggtgggtggagcacttgaggtcaggtgtttgagaccagcctggccaacatggtgaaaccccgtctctactaaaagtacaaaaattagccgagtgtggtggtgcgcacctgtaatcccagctacatgggaggctgaggcaggagaattgcttgaaccccagtggcggaggttgcagtgagctgagaccaggcctcagcactccagcctgggcgacagagcgagactccatctcaaaaaaaaaggaaaataaatagttccctgctcagaaggttgtggggaggacagaggatgggaggcacaggtgcttagaccctcctccatgtttgaggtgcctgctggccccatacacccggtccctctggctccactgtggaaccagctctcaggggtcccatgcaggatgccacgccaaacacctttcaatctccattgtgtctttctcttttgaaacaacgccgacctggatgtgaatcctgactgccactcagcagcagtggaaaccctggcaagttttgtaacctgtagaagcccgtttccacatctggacaatggagttggtggcactggtctcacggggttgtaatgaagattaaataccttagcagatgtcaaggggtctcgacctgattccttcagagccaggattctttactgagggatcagggatgggctctgggggagttcatgaaccccagaatttgcaggtgaaattgtgtgtctttgtgagaacacggttacgcatttttctgggaaggagatccataattttcatcagatccagattctttttttttttttttttttttgagacagagtctcgccctgttgtccaggctggagtgcagtggcatgatcttggctcgctgcaacctctgcctcccgggttcaagcgattctcctgcctcagcctcacgagtagctgggactacaggcataaaccaccatgcccggctaatttttgtatttttagtagagatggggtgtcaccatgttggccaggctagcagatccagattctttttttttttttttcgagatggagtctgactctgtcaccaggctggagtgcagtggcaggatctcggctcactgcaaccttcacctcccaggttcaagtgattatcttgcctcagcctcacgagtagctgggactacacgtgcttcaggcacttgctgccatgtccagctaattttgtagttttagtagagacagggtttcaccatgttggccaggatggtctcgatctcttgaccttgtgatctgcctcctcggcctcccaaagtgctgggattacaggtgtgagccaccgcacccggcctcttttgttttttagacggggtcttgttctgtcacccaggctggttggtgtgcagtaacataatcatagctcactgtttgtagcctccaacttctgggctcaagtggtcctcctgcctcagcctgtggagtagctgggactgcaggcgtgtgccaccacacctggctaattaaaataaattttttttttttttagagatgggttcttgctgtgttgcccaggctggtctcaaactcccagcctcaagcgatcctccaacctcagcctcccaaaagtgttgggattacaggcatgagccaccgtgcctggctcaaatcttttcatatgtgaacatctcagcatgttttctttctttcttttttgagatggagtttcgctcttgttgcccagactggagtataatggcgtgatcttggctcactgcaacctctgcctcccaggttcaagtgattctcctgcctcactctcccaagtagctggggatacaggtgcccaccaccatgcccagctaatttttttgcatttttttttttagtagagatgggttttgccgtgctggccaggctggtcttgaactcctcacctcaggtgatccacccaccttggcctcccaaagtgctgggattacaggcgcaagtcactgcgcccagcctcatcatgtttttttcttaaaagataaagacttttctttttactacaaccacaatactattgtcaaaactaaactttaaaaatttccttggtgttatcaaacattcaatgtccagattccagtggtttcataaatagcctaatttgcttttagtttgtttgaattaggatctaagtaaaatctacactttgtgattggttagtatgttttaagagtctttgaaactttatttttttgattaaaaaatgtttaatttagagataggggtctcactatattgcacaggctggtctcaaatgccccaaagtgctgggattacaggtatgagccaccacacctgactgattctttttttttttttttgagatggaatctcactctgttgcccaggctggagtgcagtggcgcaacctcggctcactgcaacctccgcctcccagattcaagcgattctctcaccccagtctcccgagtagctgggattacaggcgtgcaccaccacacatggataaattttgtatttttttagtagagacagcgcttcaccatgttgtccaggctggtctcgaactcctgacctaaggtgatcttaggcccaccttggcctcccaaagtgctgggattacaggtgtgaccaccacgcccagccaatatgtggtcttatgagagcattggttcttttttttttttccctgaggcagggtctcaccctgttgcctaggccagagtgcagtagctccatcatagctcactgcagcctccaactcctggactcaagggatcctcccacttcagccttctgaatagctaggactacaggcgtgtgtcaccatgcccagctaatttttaaaattgtttttgtagagatgggttctcactatgctgcccaggctggtctcaaactcctggcctcaagcgatccttctgcctcggcctcccaaagtgttgggattacaggcatgagccaccgcccctggccgagcattgattcttgatcctcatgtgcatctgagtcacagagcagggtgggggctggctcttccccaacctggatccctggaaactacccccagagattctggttcactgggttggaatgggcctgagcatctgaaagtttgaaaagctccctgtgattctggtgtgcagcccaggcagaggccccactgtgtccacttctcttgaaaggagtggttcacaccaacacccccacttccctacctcccgtgcgctcctcgagcatgacaatgtggcttctgcccccgacacatggcacaaaaaccgctctggcacaggcctcacagttgctaagtgcagagccccatcctcagtcttccttctatttacttctgctcacctcccaaaaccctcttctccttcccaggtacccactcctgatgatgcttctctttttgttggacatgccctgtgggttctttatcttattattttattttagagaccgtggcttgctctgtcacccaggctggagtgcagtggtgcaatcacaggtcactgcagcctccaactcctggactcaagccgcagcctcccgagtagctggcgagtagctgggactacaggcgtgcacccccatgcccagctaactttttctttttttcttttgttttttgagacggagttttgctcttgttgcccaggctggagagcaatggcactatctcggcttactgcaacctctgcctcccaggttcaagcgattctcctgcctcagcctcctgagtagctgggatcacaggcgcccaccaccacgcctggctaatttttgtatttttagtagagacggggttttgctatgttggccccggagttcaatttttgtatttttagtagagacggggtttcaccgttttcaccaggatggtcttgatctcctgacctcgtgatcctcccgcctcggcctcccaaagcgctgggattacaggcgtgagccaccgcgcctggccacggcagcatctcttctgaactccagagccattccctaccaccctctgggcaccaccatccacatctcctgctgccgcctcagccttaacctctgcaaaaccaaatccgttctttctctcgagctctgcagaagctaagctgtttcaccaggccacgattcaggaaacgctttgggattcagcttctgttcttgtgaaatgggaagaatccctgtggtgagctccagatgagagcacaaaggggaacaggggtgcccgcggctggcacgccatggctggcacgccatggcactcagtggggtcaccgccccctcctgctgtcccacctccaccctgcctgctcttctcctggaatgactccttctgccagctctcagctacccaggccagaggcccaaggctcccacatctctttagctactaattctggtagatccccttttggaaatagccctcaaatctaccccagagctactgtcaaagttcagggctccatctcttttggtttttttgaaaatattttttcaaattaattatttgttggccgggcgcagtggctcacacctgtaatcccagcactttggaaggccgaggcaggtggatcacctgaggtcaagagttcaagaaccagcctgaccaacatggtgaaaccccatctctacaaaaatacaaaaattagccagggatgatgctgcatgcctgtaatcccagctactcgggaggctgaggcgggagaaccacttgaacccgggaggcagaggttgcagtgagttgagatcacaccattgcactccagcccaggcgacagtgagactccgtctcaaacaaaaaaaaattatttgtggaggcagggtcccactatgttgcccaggcctcaagtggccctcctgccttggcctcccatagcactgggattacaggtgacagccaccgcgcccagcctactttttgtctggccaagactacctcagccttcttttgcctcccaatctgtctccagttggtggctgaagtgacccttctggagcaaaaccataatcatatcactccctcttttaaaattctgtgatgggtcaggcatggtggatcacacttgtaatcccagcactttgggaggccgaggtgggaggactgcttgagcccaggagttcaagaccagcctgggcaacatagcgagaccccccgtctctacttaaaaataataaaataaaatgaaaagaaaattttttttgagatggagtttcgctcttgttgcctaggctggaatacaatggtgggatctcagctcacggcaacctccacctcccgggttcaaccgattctcctgcctcagcctcctgagtagttgggattacaggcatgtgccaccatgcccggctaattttgtatttttagtagagacggggtttcaccatgttggtcaggctggactcgaactcctgacctcaggtgatcggcccacctcggcctcccaaagtgctggaattacaggtgtgagccactgtgtccggccaataaaatgaaattttatgatggcttctgcgatctggccaaattcctcagctaaatagtttagttctttctccctgtggcctctcctcccaccatgtcacctgtgaatcccacactgcccccaccccgacactgtctgcaggtgaacagatcagttttctcagccccaaatgtcagccccaccccacacctctgcctggcaaacatcactcaccggtcctcagagacacctagtcatttattccatgagtccaccacacttgagaaacgcttcttttcttcgcgagcacgcctaccctgtgctagacagtgttcctaagggctttcaaacataaagtcttttgttttttgtttttgagacgcagtcttgctctgtcgcccaggctggagtgcggtggcacaatcttggctcactgcaacctccgcctcccaagttcaagcaattctctgcctcagcctcccgagtagctgggattacaggcgctcggctttttatttttttaattttttttattttttgtatttttagtagagacggggtttcaccatcttggccaggctggtcttgaactcctgacttcaagtggtccacttgcctcggcctcccaaagttctgggattataggcgtgagccactgtgcccagcctccaactcctggccttgtcttcctcccaccctggcttcccagagtgctgggattaacagacatgagcctccacacctggcaacttctttccatttttcactgattctctgacacatcctcattgagcacctgcactgtgtggggtgttaataattgctaggcatggaggcaacagcgtgggcagctctttctcttacttgtcaggctttagcctatgctgttgcaggactgtgccttggcctggaagccccttcccttatcctcatccccaatctcccccttcagctcttgttcctcttgcaggtcttcccttaaacatcacttcctcagcaggggcctcacagacacgcccggaggttagatcctggtccctctgtgcttcctgttcttcccccatcatcacagtctacggctgtttcctctcgatgggcaaagactgtgtctggccattgagttttctgctatatccaagtgcttcgtatactgaaccatataaatgtgctgcttttattggtcaaaacggccaaatattggcaattttatattggttagcttcatagtatgtgagctaggatacttatcccatcagagaggttgcgtagcacagtgaatcagagcccaggctctggggccgcacacctgaggtccagccctggctctgccacttgtcactaagtgattgtggactggagacaaccctcaggggccttgggttcctaatctgtgacagggatgacaataatgacctcctcgtgctgttataaaatacagaaatgtactaaaatacaaaaattggccaggcatggtggcacatgcctgtaatcccagctactcaggaggctgaggcaggagaactcaggaggcagaggctgcagtgagtctacttttattgccaaagctcgggggtccatcccttttccattgcatgccactgcactccagcctgggcaacaaagtgagactgtctcagaaaaaagaaaaagaaaaaaatgtttaaaagccaggagtttgagaccctgtctctattaaaaaaaaaaaaaattaccttggcatggtggagcagctactcaggaggctgaggtgagaggaccacatgagcccgggagttcaaggctgcagtgagccatgattgcaccactgcattccactctgtctcaaaaagaaagaaagaaaaaagtcaagagaactggagctgaaaccatgaaaggtcagttttcagcaggagagtgatcaaagaaaaccagaactagacagtcgttaaaatagcaaaaacatattgcattccagactattgctgtaggggaagagtgaccttagatcagaactgggctgaactctacaccatgggggttatagccaacgagcagagttgggggcagtggatgggacattaccatgagaaagcactgggggttgggggtattctgacaagaccaacctaaagggattcttgctgagggcaggccaaggtggtcagacagcgcctgggggagagtggagaatgaggacccccatcagggatcgggggcaatcagatgtggaggatgagggactggctaagctgacttagcagtattcttgctaaaattggacgatgcagaggtgaacacggaagtccaaggcctaactggaaaagagctgagggaacctgagtgaggtttggctatagacagaacctctgagtgagcccatcaaagttactttatttatttgtttgtttattaatttatttaagacagagtctcactctgtcgcccaggctggagtacagtggtgctatctcggctcactgcaaactctgcctcctaggttcaagcaattctcgtgcctcagcctcccgaggagctgggattacaggcacatgccaccacacccagctaagttttgtgtttttagtagggacagggttttgccatgttggacaggctggtcttgaactcctgacctcaggctaattttttgtttgtttttattctctttttttttttttttgagactgagtttcgctcttgttggccaggctggagtgcaatggcgcgatattgactcactgcaacctctgcctcctgggttcaagcgattctcctgcctcagcctcccgagtagctgggactacaggcgcacaccaccatgcccggctaatttttgtatttttaggagagacggggtttcataatattggtcaggctggtctcaaactcctgatctcaggtgattcgcctgcctcagcctcccaaagtgctgggattacaggcgtgagccaccgcgcccagccttttgtttgtttttaaatttaactttttttttgagaccgaattgcactctgtcacccaggatggattgcaatggcgcaatctcagctcattgcaacctctgcctcctgggttcaagagattctcctgcctcagcctcccaagtagctgggattacaggcgcctgccaccacagctggttaatttttgtgtttttagtagagatgaggttttgccatgttggacaggctggtcttgaactcctgacctcaggtgatcaacccaccttggcctcccaaagtgctgggattacgggcatgagccaccatgcccggccttaacttttatcttaagttcaggggtacatgtgcaggtttattatataggtaaacttgtgtcatgggggttgtacacattatttagtcacccaggtattaagtttagtacccattagttatttttcctgatcctcttgagggaagagagagaccctctcatattgtttcatactcagaaaaggaaagagaagcgaaactaaaggcaggtagcctggtgcctaggaaccagaccggaaaccaaggaaccagacccgaaatcaggcctgggcgtgcctgacctaagcctggtagttaaaattcgacccctgacctagcaactgttgttatctatagattccagacattgtatggaaggacattgtgaaacctcccgttaggttctgtttcactctgaccaccggtgctcgcagcccctgtcacgtaccccctggcttgctcaatcacgaccctctcacgcggacccccttagagttgtgagccgttaaaaaggacagaagttgagcacctgaagagctcggattttaagacgctagcctgccaatgctcccagctgattaaagccactcccttcactatcttggtgtctgaggggttttgtccacagctcgtcttgctacacttgccctcctccaaacttccgccctccaataggctccagtatgtgttattcccctctatgtgtccatgtgttctcatcatttagctcccacttataagtgagaacacgcggtatttggttttctgttcctgcgtttgtttgctaaggataatggcctccagcgccatccatgtccctgcaaagaacgtaatctcattcttttttgtggctgcatagtattccacggtgtatgtgtaccacactttctttgtccagtctagcattgatgggcatttaggttgaatcatgtctttcctatggtgaatagtgctgtgatgtgtctttataacagaatggtttacattcctttgggtatatacccagtaatgggattgctgggtggaatggtatttctggtttttggtctttgagaaattgctgcactgtcctccacgatggtttaactaatttacactcccaccaacagtgtataagtgatcctttttctttgcaacctcgccagatctcggtggtcaactcctcccactccccaggcaatgctgatttgctctgtgcctatagttttgcctttcccaggatgctgcgggaatgggatcatacggccttttggatctggctccttttagttagactgatacatttgagacaggtccctattgttgtgtgtatcagtagttggtttcttctttttttgagatggattctcagtctgtggtccaggctggagtgcagcggcatgacctcagctcactgcaaactccgcctccctggttcaagtgattatcctgcctcagcctcccaagtagctgggattacaggcacatgccaccacgcccggctagtttttgtattttttcgtagagatgggatttcaccatgttggagaggctggtcttgaactcctgacctcgtgatctgcccaccttggcctcccaaagtgctggaattacggcgtgagccatggtgcccagcctgcatcacaggttgtttacccaatactcaccagttgcagaattcaaatccattttttaaaaaatcagcctgaaaaaaaaagaaaaaaatcagtctggccaggcacggtggctcacgcctgtaatcccagcactttgggaggccaaggcgggaggatcacctgaggtcaggagtttgagagcagcctggccaaaatggcaaaaccctgtctctactaaaaatacaaaaattagctgggcgtggtggcgggcacctgtaatcccagctacttgggaggctgaggcagaagaatccctggaacccgcgggacggaggttgcagtgaggtgacatcaggccacttcactccagcctgggcaaaagagtgaagctctgcatcaaaaaaaaaaaaaaaaaaaaaaaaaaaaaatcagggtgggcacagtggctcactcctgtaatcccaggactttgagaggctgaggtgcgaggattgcttaagcctgggagttcaagacgaggctggggaatatagtgagacccccatctctacaacaaaaaatatacaaaaattagccgggcatggttggtgtgcgcctgtagtcccagttccttgggaagctgaggcgagaggattgcttaagcctgggcagttgaggctgcagtgagccatgatcgtgccactgcactgcacctagtttgaatggagtgggagtgggggattaggctctcctccctgccgtttgctcccaggccttttccgtagctggatgtgaccaacagagacagtgcccagcctcagtatagctagctcttagtggagggacaggagccatctggggcagatgtgggagagaatgtggcgaaggagagccgggtgcagtcaaggaggcttgtggctcggaggggaggtggggtgagtgagtggagactcagcagcttggctttggggaagtagacaagagagggccctctttggagagcggagcaagccaggatgtctggccttcacttccacttggaacagaagtgtgctgtgtgcgcgtgcttgtgcgtgtgcgtgcacgtgtgtgcgcgctaaatcaaacaccctcgctggctctgtgttcccctcaaggggaagccaactccacggatggcgggggtccattaggctgcaggtcttctccctgccgatagatggcgctgttgcaccgcgcctgggtttgcctctgcccgcagccatgcagggcccatcacgggctatgcctaccgcgcgaggggccttcaccatgtccactatccttatttatttatttatttatttatttatttattttttaagtgtgggtactggccgggcgcggtggctcacgcctgtaatcccagcactttgggaggccgaggcgggcggatcacgaagtcaggagattgagaccatcccagctaacacggtgaaaccccgtctctactaaaaacacaaaaaaattagccaggcgtggtggtgggcgcctgtagtcccagctactcgggaggctggggcaggagaatggcgtgaacccgggaggcggagcttgccgtgagccgagatcgcgccactgcaacagaacgagactatctccaaaaaaaaaaaaaaagtgtgggtatatagtaggtgtatatatttatggggtgcacattgataaaggcatgcaatgcataataatcacatcatgggctagatgcggtggctgacgccgagatcgcgcctctgcagtcgccaggccactgcaggcgccacagtggcgacagagcgagactccgtctcaaaaaaacaaataaataaataaatcaggttaggccgggcgcagtggctcacgcctgtaatcccagcacttgggaggcggaggcgggcgaatcacgaggtcaggagttccagaccagcctggccaacatggtgaaaccccgtctatactaaaaatacaaaatttagccgggtatggtggcaggcgcctgtaaccccagccactcgggaggctgaggcaggcgaatcgcttgaatccggaaggcggaggttgaagcgagccgagatcactccattgcactccagcctgggcaacaagagtgagattctgtctcaaaaaaaaaaaaaaaaaattacatcatagagaatggggtgtccatcccctcaagcatttatcctttctgttacaatccaattgcattcttttagttatttcgaaatgtacagttattattgactgtagtcaccctgttgtgctagcaaatagtaggtcttattcattctttctattttttttgtacccattaaccttccccacctccccatcatccttttttttgttttgagacggagtcttgctctgtcacccaggctggagtgcagtggcacgatctcagctcacttcaacctctgcctcctgggttcaagcgattctcctgcttcagcctcccgagtggctaggattacaggcctgcgccactatacttggctcatttttttcggggttttgccatgttggccaggctggtcttgaactcctgacctcaggtgatccacctgcctcagcctcccaaagtgctgggattacaagcatgagccactgtacccagccccatcatcctcattttatttattttttatttttattactatttttttaggtggagtcttgctctgtcacccaggctggagtgcagtggcgtgacctcggctcactgcaacctctgcttcccgggttcaagcaattctcttgcctcagcctcccgagtagctgggattgcaggcgcctgccaccacgcccggctaatttttgtatttttagtagagacaggagggttttaccattttggctaggctggtctcaaactcctgacctcaggtgatcctcccgccttggcctcccaaagtgctgggattacaggcgtgagccaccgcgcctggccagactgattttttttttaagtgaatttgaaagctgcaactggtgagtattggataaacaaactgtgatgggattgcaggtgtccacccccaagcctggctaatttttgtatttttagtagagaccatgttggccaggctggccttgaacccctgacctcaagtgatctgcctgccccagcctcccaaagtgtttgggattacagtcgtgagccaccgcacccggtcagaagtttaatttttttttttgagacggagtcttactctgtcaccccggctggagtgcagtggcctgatctcggctcactgcaagctccacctcccaggttcacgccattctcctgcctcagcctctggagtcgctgggactacaggcgcccgccaccaagcctggctaattttttcgtatttttagtagagacggggtttcaccatattagccagaatggtctcgatctcctgacctcgtgatccgcccgcctcggcctctcaaagtactgggattacaggcgtgagccaccgcgcccggcccagaagtttaaatttaactaggtgcccagtgatctcatcaagcccacagcactccctcaccctcgcccccacaacctcccttccccccacgccccccttcctcaccgcagtcccccccctgggacccctagatcttgaggctgatgggccagttcccagtttcactggttgttaaatattttgacagtgacccctgacagcaggagaggcagccaaactcaacagctgttctctcttccccccaggcctggcgctgctgctgccgcccgtcaccctggcagccctggtggacagctggctccgagaggactgcccagggctcaactacgcagccttggtcagcggggcaggcccctcgcaggcggcgctgtgggccaaatcccctggggtactggcagggcagcctttcttcgatgccatatttacccaactcaactgccaagtctcctggttcctccccgagggatcgaagctggtgccggtggccagagtggccgaggtccggggccctgcccactgcctgctgctgggggaacgggtggccctcaacacgctggcccgctgcagtggcattgccagtgctgccgccgctgcagtggaggccgccaggggggccggctggactgggcacgtggcaggcacgaggaagaccacgccaggcttccggctggtggagaagtatgggctcctggtgggcggggccgcctcgcaccgctacgacctgggagggctggtgatggtgaaggataaccatgtggtggccgccggtggcgtggagaaggtgctggtcctgcctgtccctggtccaaccccaccctcagcacacccctcccctcccctcccctctccagagcctccagccatgaccgggtgaacagccatggcctggagtcagcaacacaagactcttcccacctcagctcctccatctgagctgggctcagttgagctcatccagctaagctaaaggggagctgggcctgcttttctttttctggagatggggcctcagtctctccagtagctggatatacaggcatgctccaccccactggctaatttttgctttttttttttttttttttttttgagatggagtctcactctttcacccaggctggagtgaagtgatgcaatctcggctcactggaacctctgcctcctgggttcaagcaattctcctgcctccgcctcccgagtagctgggattacaggcgccagccaccatgcccggctaatttttgtattttttagtagagacagggattcaccatgttggccagactggtctcaaactcctgacctcaggtgatccacccacctcggcctcccaaagtgctgggattacaggagtgagccactgcacccagctgccttttttttttttttttttttttttgagatggggtctcactatgttgcccaggctggtctcaaacttctggactcaagtgatcctcccaccttggccacccaaagtgctgggattataggcataagccaccatgcctggttttggaattggttctttatctttgttctgctgctgcgtggcgtgatgttcaagagcaaaggacaacacaggggaagccagtgtcactggcaccacagccttgagcccatctctctagccctctgcaccttatttcccatctgtgaaatgcccttaaacaccccttctaattttaatattctgagtcaaattgagctcaggtccaaatgccaaatattgctgatattcatccactttttgacccacaaaagtggtcattttaacctacaataaaacatcctggctcagtggctcatacctgtaatcccagcactttgggaggcccagttggggggattacttaagtccaggagtctgagaccagcctgggccatatagcaagattctgtctctacaaaaaattaaaaaattagccatgcttgtgggcaagcccctgtagtcccagccacttgggaggctgaggtgggaggatcacttgatcccaggaggtggaggctgcagtgaactatgactgcactgaactccagcctgggcgacagagcgggaccctgactcaaaaacaaaacagtggccaggtgcggtggctcacgcctgtaatcccagcactttgggaggctgagatgggtggatcacgaggtcatgagttagagaccatcctggccaccatggtgaaacgtcgtctctattaaaaatacaaaaattagctgggcatggtggcacgcacctgtagtcccagctactcgggagactgaggtgggagaatcacttgatcccaggaggtagaggctgcagtgagctatcattgcaccactgcactccagcctgggcgacaggttgagaccctgtctcaaaaacaaaacaaagcaaaaacaaccccaaagtctggtttccttattaaccccaagttcatggtccacccgaagcttttcaaatgtcagtcccggctccccgcgccccagctgcagtgctgggccctatcgtcaccctcgccctcccggctccctgcgccccagtgccaggtgctgggcccagtcctcacccttgtcctcccggctgcccagcaggcggtgcgggcggccagacaggcggctgacttcactctgaaggtggaagtggaatgcagcagcctgcaggaggccgtgcaggcagctgaggctggtgccgaccttgtcctgctggacaacttcaagccagaggtaaggtgggctctgcctccggggagggatctgtggtgggctcttacctccccttggcttgtgtcccgcaggagctgcaccccacggccaccgtgctgaaggcccagttcccgagtgtggctgtggaagccagtgggggcatcaccctggacaacctcccccagttctgcgggccgcacatagacgtcatctccatggggatgctgacccaggcggccccagcccttgatttctccctcaagctgtttgccaaagaggtggctccagtgcccaaaatccactagtcctaaaccggaagaggatgacaccggccatgggttaacgtggctcctcaggaccctctgggtcacacatctttagggtcagtggccaatggggcacatttggcactagcttgagcccaactctggctctgccacctgctgctcctgtgacctgtcagggctgacttcacctctgctcatctcagtttcctaatctgtaaaatgggtctaataaaggatcaaccacatggggttctgcggtgataatgagcacatagtgaggggtcagcaaatgtcagaagttacctgggacagccgggcacgatggctcacacctgtaatcccagcactttgggaggctgaggcgggaagatcacttgagttcaggagtttgagaccagcctggccaacatggtgaaaccccatctctaccaaaaatagaagaattagctgggtgtggtggcacgcgcctgtaatcccagctacttaggaggctgaggcaggagaatcgcttgaacccaggaagtggaggttgcagtgagctgatggtgccactgcactccagcctgggtgatagagcgagactctgtctccaaagaagaaa

SEQ ID NO: 60 - DNA, 3557 bp, Homo sapiens
ttttgtttacattgtatttattttcatgttttaccttctattgatggcaaatgagactggttttccatttacagaagtgatacaaaagattcctgttgcaataatttcattaagtgaataatgagccaatttaaagaaaaatataaagcaaataattgtacagatggtaaactaatatggcaaaatcactaatattcaaggctgaagtttggccgggcatggtggctcatggctgtaatcccaacactctgagagatggggatgagtggctctctcgagcccaggaattaaagaccagcctgggcaacatagcaagaccctgtctctaaaaaaaaaaaatagccaggtgtggtggtacatgcctgtagttccacctactagggagactgaggtgggaggatcacttaagcccaggagttcaaggccgcagtgagctgagattgtgccactgtagtccagcctgggcaacagagtgagaccctgtttcaaaaacaaaaaaaagtggccgggtgcagtgctcatacctgtaatcccagcattttgggaggctaaggctgctggatcacttgagcccaggagttggaaacctgcccaggcagtatggtgagaccgtgtctctacaaaaaaaatacaaaaattagctgggcgtggtggtatgcacctgcagtcccagctattctagaggttgaggtgggaggatcgcttgagcctaggagttcgaggctgtagtgagttgagattgtgccactgcactccagtctgggtgacagagttgagattctgtctcaaaaaaaaaaaaaaaaaaaaaaaaaagacaaagtttggaaaattaaacccccagggaaatggaaactacatctgctgctcacccacctgcctgcctctcctaaagggaagattgggtacttggggtcccatttctgtagggtggagcattataagtaagcctagcttgtggcaaatctgtctctctggacactccagcaagctggaagggacgatgatcagaggtcacagtttgggagttgccctgctctaggacaacgctcctctccacattggatgaaactcagtttcccctggccatggccttcctcaccatggagtggtgagggtccgaggctgagacgtgtgcagatggaggagaatgggcagaggagcctgtgggttttctctgactctaggtccccactccagcaagacagcgccgctgcagcttggcccagcaagttcctccttgcagtttgggggtcaaagccacagttcatatgaaacaaaatgttcctctgcctggtctggtcctctctttgtgtattttcctagaggacctcacagtgggtgagtggccaaggagaacaggatttgtggctctgggaaactggattcctgtcatctcctgccagctgtcatcgccacaccgaggctgttcagcaccgcaggacccgttctctttggtattggtggcttcggtaaacactgaaagaaggtggaggtggctggtcgatgccatttcctgactatctagtaccttgggttcttcatctggatgcgatcttgaaggcttctggcctggcattggctccacccccaggtctctgagccacagcccaggtagctgagcagaggcactgctgggcttcccctagtccacatagcctggccaccacccagacccggggagggggactccaggtggaaggagcctgggaagggcatcttcgctggggcagtctcaatcctaatgctggatcctggggtccccggtcccactgaggcaaggcctgcctcggggatctctggggaaccctggggattcagaaccccacactggtccggccttcacgcttccagaaagctgagatctgctccaaggtgacccgtggctggaggccccactcaggatccgggctccctggccgctgcctcctggcctgggggctcccaaactggacgctggcctctggcctctgctcgggttcagcccagctcaccaggcctgtggcggggggcctcccctcccagggctggggcccccagaaggtgctccgggctgggacctccagtacggtctgggggcccaagttgctgggagcagaatttggggctgagggggcaggtggggctgttgctcgggcctccaaagtgcccacctgggtgggaggctcaggggcccgatctgtcagcagggggaccgcagagccataccagtcctcagagcgctctcgggcggtgcccatgggctcaatccacagctctcctcctgggcgccacaccagggtgggtgcacggtggctggggtctgggcggagagcacggcggaacaggcgttcagccaacacagcggtggtgaggatgaagagcgcagccagggtggccaggaccagcatgatggggatgcagggcccacagggcagtgagggccatggggctgcttcccatgcggggggcccctccacgcgcccagagggcggctctggagtcaacggcatctgagagacacaggggtgagaagaggaagtaaatgaggcagagggggcacaaccaagatgagagagaggcagcaggtgtccaggaaagcctgggagaagggctgggcatgggggctcatgcctggaatcccagcactttgagaggtcgaggcgggaggatcacttgagcccaggagttcaagaccagcctggacacacagtgaaacctcatctctaaaaataatttaaaaactagctgggtgtggtggctcacacctgtagtcccagctacacaggaagctgaggtgggaggattacttgagcccaggagtttgaagctgcagtgaccccagattgcaccactgtcctccagcctgggcaatagagcaagaccctttctcaaaaatgaaaaagaacattctggagagacagagaagcaagagggaccagaaagggtaagcgtgagccaggtggggtgggaggacaggcagcctacctcggggcacagccaggccctcctgcctggctctccaggcctttccagaatccccatttccctcccagaccccagggtgcctcagacaagaaaggtctcaagggcttctttcctccccactcggccccctcaagtcttgctcagacctagagaggaagtggtgggtgaagaaatgagaacctcccctcccactggctcccctgcgtgtgtctcccccaccgcctgccgccagcacctccgctggccccttgaggctccttcgcccctcaccattctcctcggacttgatcttgctctcataggctccacggaatctgctgccgggccgggccgggccaggcctccggaggcgcctctgcacccctcctgggctccccagctttgcccaggctctggcctgtctctatctctcgtttgtctctgcacacctctctgtcccccacatcctccatctgcagggggcctcctgcacccctcaactcaccttgggtcagtccctgggctcctctccctcctagagccactcttcctggtgctggactaagaggtgcaggcttggagggtgcagggcggtccgcctctcagacgtagag

SEQ ID NO: 61 - DNA, 14649 bp, Homo sapiens
ggcgggcccaaggagggagtggaatggccgcgggcggctcgacgcagcagaggcgacgcgagatggcggcagcttcagcggcggcgatctcaggtacttgagcccggcctgggcaaggcgggtaccgacgtctggagtttagtgggagttatgtgtcggagtgtggtccaggctctgcgggttgtcgcggagaggcggccatggcgcaggggcggggagagggggacggtgagagtgtggggtcgcgagccggtcgccccgcctggctcctgccttctccctgtttcctgctctccccttgggtcagtagactcgggtctccggtccaggctcttggcttgaaccccgcgcactttttctttgtgagcttcggtttcttcgtctgtgaaacgggggtcatggcctcatccctggagatcacctgaataagcaagagaagagtggcggacgctctagccacgaggacgagaagaagggagccggaggcgtgtattgggaagggttctgtgtgggacatggtgtttgggtgcagagacatccctgagagatgcaagaggacgggctgaggaacagacccggctgctgctgggtttgagttggcagcgtaagatgctctgcgattacaggaaaacgaaataaaagactaaaatttcctttcactctagcatggaagtgaatgctattttagggttggaaaggctgttaggacacccaaaatcttgtatgtgagtatttgtttacatgtgcctctctaacccggagacttaatcctcgttagtgatgatggtgagcgccatagtaattcactggagccctcgttagcctcgtggggaaacagacatttaggagaatgcctaacacatgtagagctcttgctatgtgccaggcacagttgtaggcattttatggtggtgaaccatttattgtccacacaatgctatcaggttgttactattactgtctttgttttacacaggaaactgaggttagtttgttcagagttaacacaactagtaaatattggggcttgaattcgctctcaaggagtctgagtgtagaacctctgctcttaaccattatgcccaagtacatgttatccctgctggctgagcacagtctccccttacccttcgaagatgcactgtgtccggtgcatggtagatatgaaaatgcctgaatgaataatgtcccttcctcgaggaatttacagtctgtttcaatagagtgtcacatacgtagatgtaatacgaaacacaatgagagatgtgtataaactgagggtgtggaatctgaagtaagcccttgagtattctgggaggacttcattaagggagtgaatgatacttgagatgggtttcaaaggttggataggagtttgccaggccttgactaagaagacaagaacagcaagtgttttcttatttatgatgtaagatgctctcttagctcaatttcctcatcaataaaagggagaagagtgaatgaaatttaggaattgtgaaagaagggaaaattaataattgctagcctggtccaagctcaaggttgcttttatcatgaaagggctagactcttgtgcagtaaataattgtttacatgtggccctcccctcttccctcctaccctggactgtgagccctggggcaggaatggccgtgagccattttcatgatggaaatgaacaagccagtgattagtagtttattcactaaatcttaatttttttcagcaaatacttcttgagggcctactctgcgccaggtgttggggttagaaaggtgagcaggataaaacttgttctcacagttggcagtcaggtggagaaagtgacaaacacgcaatagtggggtgtgacaaatgcttatggaggggctaacatgagctgtggttgcacctgataaagccttagtgtctaccaggaaagggtttttggttttgttttttaagaggagttaaaatgtgtttaccttagtcactccagggtggggtggggagcaatgcagatattctagggagagagattaacgtggacaaaaatccaaaggtgcaagagaacttggagttttgtaggaagtgaaggaaattcatcatgactggtaacttacactgcaaggaaggaaacagagggaatgactagagggcagggagacaccttgctaccaccagcaaggaaggctgtaaagaccatgaccttgggcagaggtagtgcagtgggagtggagagaagtggacttgttcaagagagatttaaagagatagacttgacagatgttaatgatgaactgatgtgggaggtaagagacgttggagttaaagactcccacttttggggttggtgccattcatttacatcagagatcaaaggaggaggctgcagagagatggggaaggagggttcagtttaggacaggtggagtttaagaggagccgtcggctgggctcacgcctgtaatcccagcattttgggagaccaaggtgggtggatcacgaggtcaagagatcgagaccatcttggccaacatggtgaaaccctgtctctaaaattaatcaaaaattagctgggcgtggtggcgtgcacctgtagtcccagctattcgggaggctgaggcaggagaatcgcttgaaccgggaggcggagattgcagtgagccaagagcgccactgcactccagcctggcgacagtgagattctgtctcaaaaaaaaggagccgtcagggcagccgttcagaacgtgggctgcagttgagagctcttgtgcagaacgtgcaataggacttatcagctgtaagatgttactgaagccaagagggcgggtgacctgcctatgaaatgaatctgagtggtctcagctcggggcaactttgtccctcacaggacatttggagatgtctggagagatttttagttgttacaacttgagggtgagggtggagaatgctactggcatctagtaagcatatgctaacagtctaaatgcacaggacagccccacaacggaattagccagcccgaaatgtcagtagtgctgaagttgagaaatgctggtctagagaaaggatagacggatcctaggatgaggagtgaacagaaaactaggtaagacaaccaggaaggtggggggcatggaaatgaagggaaaagtgtgtttcccaagagtgtcgcatacttctgggaggtccaacaggattgaggctgagtatgcctactggatctagcactagggaagtcatgggtgaccctgctgaatagtgagggcagaagcaagttgcagggatggaggagtgggtagcaagagaaagggtgtaataataacagctaaggactgagcagttgctgccaggcactgtgctaaacattgtatgtacattattactttgaatcctcacattcttatgagatgcaaagatgaaggggctaaggaggctgaggagggttcatataaagcactttggagttagatcttcatttgaagctgtcagtcactagctgttgaccctgggtcagtcagctaacccctctatactgaggtttcctcatctggaaaatgggagacggacattaaaaagcacttactggcctttcaccaaataccagataatgttctaagcacttttacatgaatcaccttaattactctcctaacaacctaacaaagaggtatttttattcccattttgcaggtaaggaaattgaggcactgggatggaaaataatttccctaggttacttagctagctgtaaatggcagagctgggatttcaacccaggccattttaccttgaatgatgaacctacctactatgtgctagtcactgtgctgccactttatctggcacttatttcaattatcttttttttttctgagacacagtcttgctctgtcacccaggctggagtgcagtggcgcaatctctgctcactgcaacctccacttcccgcattcaagcaattcttgtgcctcagcctcccaagtagctgggattacaggcgtccaccaccatacctgactaatttttgtatttttagtagaggcagggtttcaccaccacgctggtctcgaactcctgacctcaggtgatctgcccaccttggcctcccaaagcgctgggattacaggcatgaaccactgcgcccggccaaattctcaaaaagcccaaggcccacccccaaccttattttacagacaaggaaaccaaggtccaaggtcacaagctaataaatgtcagagctggaattgaagtccacttctgtctgaccagagtctacactctacctcattactgacttccccttccccttagattgatcactgcgcttccttaagtgcttctacatctgccatctttctgttctcccaaaacatcctgtgaaagcaggcagaggaaggtcctgcacatatttttgacaagtcagtgcacctcagttttctatctgcacacatgcatctgcaggtttttacctgcttgctcctgactttcaggattgccatgaggaacaaatgagaactagatgtccaagcgctttgctaccataacgtgagaaatggtattagtagccccatttatcagatgatggaatggaggttcagtttttgaaacagcccgtctgcttatgggcatgccttacttaggtgtaagattctttgtaggggtcatctgtctgccttttcgtcttgctgtttctgtgttggctacgtataccagccagccttttgccttctgcgaggcctatggctcctagcaaccagctgctaccaccagcaaggaagggaaagagctgccaggagctttcccagttggtacataataaggaagcaatacagcatcctattaaaagcagatttttagaggggaagagatctaggtttgaattccactatgagctacagtatgttatcctccaacgtaaaatagagtaatactctccttagatattttcagctcatttaacccccacaaaaatagagggcttttctttttttaagttttatcttcattgtgttttctgatgataaaaataattcagttgccaattctaaaacaaaacaaaacaaaaaaaacttaatcatctgaagcaaattcagggttaagtttacatgagagaagaattgcatgtcggtggtttttgcagaacccacataattccccatcaagagaagatcatcattaacagtttgcaggggtgggtgggtctgtgagtatacatacgtctcaatacatattagaaaccccagttaagaaatggaggtacaggctgggcagggtggctcacacctataatcctagcactttgggaggccaaggcaggcagatcacttgaggtcaggaatttgagaccagcctggccaacatggtgaaaccctgtttctactgaagatacaaaaactagccaggagtggtgttggggacctgtaatcccagctactcgagaggctgaggtgggaggatcgcttgaacctgggaggtggaggttgcagtgagctgagatcatgccactgcactccagcctgggtgacagagcaagactgtctcaaaaaaaaaaaaaaaaacacacacacacacacacacagaaaattctggcagttcgctctctggtttaggtttcggtcagatgtcaacccttttaatccttagaacaaccctgtgaggtgctggtctacttcacccttggcaattcaaaacatgtcctgggccaggcatggtggctcctgcctataattccagcactttgggaggctgaggtaggaggatcgctggagcccaggagttgaagacaagcctgggtaacctagtgagactccatccctctctctctcttttttttttttaagtgcccagcatcacctgggagcttgttagaaatgcaaaatctcgggcatcaccccagggagacggagaccaaatccacattttcacaagatcctccaggttatttgtgtatacattacagtctgagaagcctgctatacacctgctgcacttgcttgtagagcagggaaggcactgaggccaagcttaggggtgtccacaacatgaccagggcagaatgagcttctccaacatgagctgtggcccccagcccgcccagcaaagttggtccctgcttcttctgctaccaccatacttcatgtctaaaagtgatcttctctcctccaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtaaggttcaggccactcctcttccctcatgccatcacctccctctcctaggcctgcccacgttcccctgcctccccaggatccttgctccctccttagcaccgctttgttccctgagccttcactgttcacttaggaaatgttgacaggtgcccccatgatgggccctctctgggatactgtagggagagatgagaggttgaatcaaacatacattactgtgcacagagagggaggagcaatgagggtgagcaggtgagccccaagtagaggctgggggacatatcaggagggttggcggaacacagacctgccagccagcctacccaagctgcagctgggtagtgtcagagaagaccacccagatttggggacagaactcagaagggcagctactttataatcctactggggatttaaagttcaaactccttggcctgtttttctaggcgggggctggcaaaccatggcctgcaggtcaaatctgatcaggagtaagattttcagtaaataaaattttatcgtttatttacatattgtctatagctgctttctgactacagtggcagagttgagtagttgtaaaaggaacacatggcccacaaagcctaaaatatgtacaatctgcctttttacagaagtttgctagctcccatactaggccgttaacaatttgggcttcagtttctttccagcctcattccctcaatatatattaaactccctgctgtggcctaagctgcacttctccaccagaacgcagtggataggtgattggtatgtagagtctagttcagtcataagcagcatcctctattttccccattatggtgtaaaatacaatgttctacacatgtagccatttgaaaaagactgggaagccttgcttttttgctattcttgattctcagaatttctttctttggtcaaaatcttccttccttgagcagaatcagttactcctttgagagtgtgttcttatcttcgtttcctaaatcacagcaaagtgtggatatctatcctaccagactgaaaaactccaagagcagggatatcagatctatctctgtattcctaacaccaatagagagatgaggatggagtaggtgttaggtggatgctttttaaggtctttgtacaagaaaggggatagagacgttctcttaaatccaaggtccagatgagagtagaatcccttacccacccccaccccactccaccccttacacacacacacacacacacacacacacacacacgctaatttctttctttcttcctgcaggtttgatgccttctatggggagaggagtactcagcaggacatctatgcaggttcagtgcagcccatcctaaggcacttgctggaagggcagaatgccagtgtgcttgcctatggacccacaggagctggtgagggagccagaaaagaaacagctatgggtcagaaagggctggggaaacggagaggaaaacctcacagttttctccactctcttcccagggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtgaggccccgtgctggttgggagaggagcaacaaagggtcaaagtaagacctggttctagaacatgaagctctgctgtagcagggaggtaaggtgagacctagaaagacagagactggggtagcagatggtacaactccgagaatagaacagagaaaggaaactgatccccaggaagaaacagcctctctatggagaattgcccttccccttcactgcttacacaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtgaggccgcagacaggggcgaggacctgggaagcccaggagcctgagctaagcacgagacctttgttcttacccccaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggtcaggcccacctgtctcagggaagaaggggctgcagaaggaggttctcaggcctgctgtggggtggggaatagcagttgaggcataggaaggctgggcttctgacccacccactgcctggtctcaccctcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatggtgagaactgggggaggcaggagtggaaacgctgggtctggaaattagggagtttgttgaaaccaccaagcatcagcacagaggctgaccacccccaatccctctctccaccccatcctccaatcatctagccttgggacctgttaagctgtctcagaaagaattgcttggtccaccagaggcaaagagagcccgaggccctgaggaagaggagatcgggagccctgagcccatggcagctccagcctctgcctcccagaaactcaggtgagcagtggggccttgggtgtatccccttcctgatgtatggcttagcagcagagctgcaatgcccgtcagatccttgagcagagagctgtgatcttgttcctctcccattaaattcaccctaggccggatgcggtggctcactcctgtaaccccagcactttgggagactgaggttgggtggatcacctgaggtcaggagttcgagaccagcctggccaacatggtgaaacctcatctctactaaaaaatacaaaaagtagccggatgtggtggcatgtgcctgtaatcccagctacttgggaggctgaggcaggagaatcccttgaacccaggaagcagaggttgcagtgagctgagattgtggccattgcactccagcctgggcgacacagcaagactccgtctcaaagtaaataagtgaattcaaccctggctaggcacggtggctcacgcctgtaatcccagcactttgggaggccaagacgggtggatcacctgaggtcaggagttcaagaccagcctggccaacatggtgaaaccccatctctactaaaaatacaaaaattagccaggcatggtagtgggcacctgtaatcccagctactcaggaggctgaggcaggaagaattgcttgaatctgggaggtgaaagttgcagtgagccaagatcatgccactgcactccagcctaggtgacagagcaagactgcatctcaataaataaataagtaaataaataaattccccccaaattctactccattgaatcactaaagtctaagattaatctctcctcagtgctgctgccttggggacctaaggaggcctcctcctggggatcctttccattttccaacccctttagccttcagcaaaacttctcactttgggacagctgtttcaaggatgagcatttttgcttctggttcaaggagtgatctggatcagatctttcagatccatgagagcaaagcaaaggagacttggaagagctgtcctgctgagaccatctggtctgtgtgtcagtgcccagcttctccatgactctccggggagccagctgctgtcctaactgcgtctaccctcaatccagataaagcctctaaactaagtcctttgtgtcacctcctgccccaactccaatcaccccacctcatggcccagtatgtactaatcctcaggtcatctctgttcaggggtcttgctttctgtgtctggccacttagcccttgcgctattccctccaccccccaggagccagttgcagttttaactttgccctgtttctacccctagcccaaataaagcctgtgaactactaaacagaggtgacctgaggtggccaagggttagtgcccactctgtcccagggggctactgtagttaaggaagatgccacacacaagaagatgcttgtgcactcatgaccccatctctcagtcttgtctttcccaaaccatctgtcagcactccccactgctgtgtgcacccagaaatgtgcacaggtaagctgtcagacaggcactctgagtaaggggaagctcagagttgggcacatcaaacccagcagacccagagcttgggggcctcacaggagagcaagtcagatgggaacatcagtatatgataccaggtggagaattcagaatcaggaaggagtagctgctgctgctgtgagagtcaggaaggaagagatgacttctagtgtttgcccacgtatgttctgatcctgtttttccaaggcactagcatggaaagcacaggagtgtccctgtcctccaggagccagttcacagcataggaagggagatgcattgttaagcttggcgtcatgggaaaggtggcatcaaactgacctggaaagattattgatacagatgtgaggaggtgtggggcaagattccaggcaaaataaatgaatgttagacgttgctgactgggcgcagtggctcacacctgtaatcccagcactttgggaggccaaggtgggtggatcacttgagcccaggagttcaagaccagcctgggcaacatagtaagaccccatctctacaaaaaataaaaaaattagctgggcatggtggcatgcacctgtggacccagctactcaggaggctgagacagggggattgcttaagcctcaggaggccaaggctatagtgagctgtgatctcaacactgcactccagcctgggtgacagagcaagaccctgtctcaaaaaaaaaaaaaaaaaaaaaaaaagaatgttaagccttaccgtgctcagagtcagtcaggactgcttgaacaggccttcccagctgcccacagcagggaagcttggcagctgaggtcttcggtggatttcaaagccctgctaaagatggcatcctctgtgatgttttccgcaactgctcctccaaatggataggcactgtcctggctgtcaccttattatggtctcttgatttcctcagtagacagtgcctccagggcagggcagtgtcttaggtctctcatacctggcactcaagtgttcgcctgatttcctggcatccccgagcagtcacttcacctgatgaagacactgcacccagagaaactggatgcctagcaagttaacattaggttctggagctacaggatataccaagttaaggtgtggtgaggggagtcctgctgctgtaggtggtgatgagggaggaggtaggtggggagcaacttctttttctgctcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtggaagagaaggacctagagattgaggtacgtgttttagggatgtgggagctggattcctattggccttgagaagcaatccttggatcttcagacagggaaggacactcaggctggactagagtccagttttctcccaataccggaagttctccagcttctgcttgaatgtccttaacatggctgaactttgacagacaattgagaccagatgtgagggtgagaagaaaaagttcaaagtaaaagcaacaaatgttaaacattacatttcctaaagcccagctcaattaattgaggactgtgcttgaaaagcctttcccttcaatatttgcagaggcttgttccacctctgggtagccccctaatcacagaaagcccttaattatgttaggctccacctgtctcctggtaacctcccactggtcctagccctgccctctgggggctcagagccttgcatactcaccctggtaacccactcccttcaggctgccctggagttgggtctggatcacatctccctgatcctttccaacagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaagtaagtttgactccaggggctggggggccaaggcagctgagatcctataagggaggaagtgttaggagcagctgtctccatgtcattcatattctcccaccacataccagtcccagggaggggtgaggaggctctgaggcagtgctgggggtgctctgccctcgggtgtttaggacagtgggatggacaaacgagtagaggattgaagataatgcaagactgactgaaattcctttaaatgcgggtataaaaaaggtcatgtggaaacacaacaggttaactctggatggaggggagctggggaatcagaaatggaagaatcgaagggctaccagggagggtgaaaagtaccctttgccctgactccaattctcgattcctactttcagttcaggagcaggcagcatccccaaatgccgagatccacatcctgaagaataaaggccggaagagaaaggtgaaagtagctgggggcttaggctacacctggagcccagaagtaagggggagtaggctctagggggaggagcgttggccttggggttaaacgaactggatgatggccgccagctactaacagacctcaacttgcttacccctggaatgtggtgatggatggttccttgcagggcatttagggtggaaggcagtgatgtggatgtacctcgcagagcggatgttccactgtgtagcctggcttctaccctctacaagcttaagagggaaaacttagggaactatgacctaagcagtcaagcaagaaaccacacatatgcacatacccagaatcgaacaccactagaactacccaaaaactgagatggttgggggaggtatcatttattcatattactttctcccatgtactttttgaaagacagcttattctttcccttttagagatgagggaccagatttaagagcttattttgtgctttacattcattaactcacttgatctccacagcaactccatgagaagggtgctaatattaccactgggtactgagtagtacctctctttcactagttgcataataagaattaacccagagagtgacctgagggcgggattttggacacacttgacaagagaggaagaggctggagcgcaggaggtagctggtgctgggctcctagtcttggcagaggagcccaaagcacttggctgccctgcgtgtcactcatctccctttgcctcccagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtagcagcccactggactgggggagggcgggggcgggggagaccgggtacccccgagaccctgtcccctatcgatcctgtcccgccaggtggaggacctggaacgcgtggagggcataacggggaaacagatggagtccttcctgaaggtgaagtcacggccctgcccctcctctgcctgtcctgcgccccgcgcccctctctaacgtcgctgtctccctccctcctgtgttgcaggcaaacatcctgggtctcgccgccggccagcgctgtggcgcctcctgaccgtcgtctcctcactccgccttttcaaatttttgtataaccccgtgttgtgtaaatacagtttttgctccggtg

SEQ ID NO: 62 - DNA, 3794 bp, Homo sapiens
gtaacgcgtggctcccttgggctggcgggaggggccggaggctcgcgaggggcgggggcggcgacggcggcggagcgtaggggaggggaccggagaggaggggatgagcacacgggagaggagaagagggagacccgccgcctccctccctccctagctgacttgctccctcccgggctgcggctgctgcaaaagccagcagcggcagcgggagctgtccggaggccggcgtcgaggtgagacccgggcagactgaggctgcgggtaggagtggaccgaccgacggctgacgccgggcggactgcacgggaatgcgggtgtctggagggctggtggtggtgctgggcgggctgaaccatcgggaggaggcgccagcccaccgaaggcgagggaagccccgggagaggggctgacaggggatcgaaggagataaccaggtcccccagaaaggggcgggagcgtcctcgccctaaacgcgcagcaagaaaacccgcaccgcctgggagcccagggaggaggggaggatgcagagggagtggaatgcgaatgtcgggtcctctgcccagtcggcctgtcggagtgctatttgcacagctcgttgattttggggtgctgggatctgagagtctggatcttgttggatggacccagggagagaccctggagaaggtcctgtttacaaaagggttaatcttccccagggctctccaagcagaagactttgagtagagcactcctcccgcagggatgtcccaccctaaggcaaaggaaaccccaacttttcttcctctccctagaggcagtgcaaggctggccctgagacaggaatgtggcccaattgggcctgcagtgctgagcgccctcttccctcctcaccccaagcctatctcctcctcttccagggtttgccgctgtctctgctattccatcctccccataggggctctctcccctctcccatctcaagatggcagccagcagctctgagatctctgagatgaagggggttgaggagagtcccaaggttccaggcgaagggcctggccattctgaagctgaaactggccctccccaggtcctagcaggggtaccagaccagccagaggccccgcagccaggtccaaacaccactgcggcccctgtggactcagggcccaaggctgggctggctccagaaaccacagagaccccggctggggcctcagaaacagcccaggccacagacctcagcttaagcccaggaggggaatcaaaggccaactgcagccccgaagacccatgccaagaaacagtgtccaaaccagaagtgagcaaagaggccactgcagaccaggggtccaggctggagtctgcagccccacctgaaccagccccagagcctgctccccaaccagacccccggccagattcccagcctacccccaagccagcccttcaaccagagctccctacccaggaggaccccacccctgagattctgtctgagagtgtaggggaaaagcaagagaatggggcagtggtgcccctgcaggctggtgatggggaagagggcccagcccctgagcctcactcaccaccctcaaaaaaatcccccccagccaatggggcccccccccgagtgctgcagcagctggttgaggaggatcgaatgagaagggcacacagtgggcatccaggatctccccgaggtagcctgagccgccaccccagctcccagttggcaggtcctggggtggaggggggtgaaggcacccagaaacctcgggactacatcatccttgccatcctgtcctgcttctgccccatgtggcctgtcaacatcgtggccttcgcttatgctgtcatggtgagccccatgggaccctagcccaggcctgctgtggctcccagcttcccgccagcgctgcaatagagcctctggagtaatcatgccttccttcccctctcctctctgcatggatcccacctccccaattccagggcctttgtttgcctctccctaggacctaaccctctgagccaccactgccctgcccctttgggtgggagggatatggaaacacgtgtcacacagcctcgctgacctgtgccctcctccccctgccccttcactcctccttcctcccttacccgccatctatggggctggcctctctctcttctggatgacttttccacctgatcccttctgggctggcttctcctgaccccggctatgtgcctccacccctcgccctaaccccagtcccggaacagcctgcagcagggggacgtggacggggcccagcgtctgggccgggtagccaagctcttaagcatcgtggcgctggtggggggagtcctcatcatcatcgcctcctgcgtcatcaacttaggcggtgagtgggggcttgggacaggcaggggaggaatggaagggttggcaagggcagctttactaacccctgcccctgctctctcctgtctgtcctccttacctctcctttgtctctccttgtctccccctccccccgtctgtccttccctctcctctcccacagtgtataagtgaggggctctgccccgcatcccaagacttttcttcctgttgggagctgccttgggcccatccctcccctggggggagcccaactgatggccctggcccccacccctaaggaccaagggagcctgagcggccttgtttacagcttctgtcctgctcctgcatcttgccaggctcctctgccaactgtaggcctgcctcatccctgcactggttccaacctccctgcactaatgcctgcatcccctccggcctcttggccccctatccctgcacttctggaaacctccctgcactctggaaacctccctgaacacctccccaactctgcgctctcagcctccctgcatctctcctggcctccctgcacttcttccagccccccaaattctctggacctccaccctggccgcctcctcccaactttcattgtcttggcatctctcaaccctcagtcctctcttccttcccttctttatcatctcccctttcctctccacgtcccgcccccttcctcttcctgcctcctcatctcccttaagcatcctcttctccaacctcccgtcaccgtttactctgcaaaattgacagcacttagacgaggcttgggggcagggagcagtgttgggagagggctccccaaccccaggctcggactgttctctgctgggaccacccagggtcggacacccaagggtgcctggcaggtcgcagagttggcaagccgggcctcgtatggggactcgggtgagggtggcgagtactggttccgaacgcacgcaggggagaagggagggacgcggcgctgacccttccaggtcagctggagttgacccgcccacctgggcttttcaaccccagtccgcgagtttctttcttgaaggtgtgggggctagattcattcacgtgcttcgtaatgaaataatccaaaaaataggaccaaagcgcccactggcaggagcgagggcggggcgccgcgctctataattattttctaagatgatgggggaggtttgttgcacgcgacagcccgctgaggaggcggggaccgagctacaacgcggttcggatttggcgggggtttttttccttaaaaaaaaaaaaaaaaaaaaaaaaaaagtctgggggaagaaaaaaactaaaattcttaaaaaaaaaaaaaaaaggctattatcaaactgatttctccctttttgtatgccggatgctgcatgagtctgaaacaccaataaacggagactgcatgaga

SEQ ID NO: 63 - DNA, 6289 bp, Homo sapiens
ggcgccgtgtccgggtgtggagaggggcgtcgtggaagcgagaagagtggcccgtccctctcctccccctttccctctttcggaaagtggtttctgcggggcccgggagcctcggagtaccgaacctcgatctccggggcggggtccttggtggggactgagcgccccctcccggggacgggcggtctggccgcggagtcccctgcgggagcgtgattggctggaaacggtcccgaacccccaggggagcccgatccctgggggaccctggcttcggactccagtatctgtcgtcgcagggtccctgccctagtggcctatgtcccttgctcggggccatggagacactgcggccagtacggcggcgcctctgtctgaagaaggggaagtgacctccggcctccaggctctggccgtggaggataccggaggcccctctgcctcggccggtaaggccgaggacgagggggaaggaggccgagaggagaccgagcgtgaggggtccgggggcgaggaggcgcagggagaagtccccagcgctgggggagaagagcctgccgaggaggactccgaggactggtgcgtgccctgcagcgacgaggaggtggagctgcctgcggatgggcagccctggatgcccccgccctccgaaatccagcggctctatgaactgctggctgcccacggtactctggagctgcaagccgagatcctgccccgccggcctcccacgccggaggcccagagcgaagaggagagatccgatgaggagccggaggccaaagaagaggaagaggaaaagtaaaggcacacccttacaccttgtcccggggctgctcccctgatggcgggaggaaatagggaggggaaaatgtgggacgctggaacctttgaaagtggagggagggaagccagcgggggaggaggaacgggcaggggagaagcacacgtgtgggtgggagggaggaccgccctcacccttaactatgttcacctgtcccagaccacacatgcccacggaatttgattttgatgatgagccagtgacaccaaaggactccctgattgaccggagacgcaccccaggtacaaacgaagaggaaacagttgggggaggtgaagggcctcggctcagttacccaagatcggctcccctagaggcctttgcttgctgcctcagctcccacacaacttacagctgcaggagagagtattcacccagtagcaccatctttatgacttagattactaccttgtcttccttttttttttttttttttttttgagatggagtcttgcccttgtcccccaggctggagtgcaatggcacgatctcaactcactgcaacctccgcctcctgggttcaagcaattctcctgcctcagcctcccaagtagctgggattacagacgcatgccaccactctgggccaatttttgtatttttagtagagacaggctttcaccatgttggccaggctggtcttgaattcctgaccttgtgatccgcccacctcagcctcccaaagtgctaggattgcaggcatgagccaatgcgcctggccccttgtcttcctttaagagacaattataatacaaaaaattagccgggcatagtggcgggcacctgtagtcccagctactcaggaggctgaggcaggagaatcgcttgagcctgggaggtggaggttgcagtgacctgagatcacaccactgcactccagcctgggcgagagagtgagactccgtctcaaaaaacacaattacagataattctttttttaaaaaaacaactagtcattgattctggaaaattacagataattctatcatgtttcccattcccagaagtccaagtcctggcctttcaatattatctagatctgcatccctctactaccatgtacattctttaatcacaccgctggccccatttcccaccccacatgccttcctagaatttaccctcagagtcatgcctttccttttttcttttttttgaggggtggagagacagagtcttgctgtgttgcccagactggttggtctcgaactcttgagctcaagtgatccatccgcctcggttctcaaagtgctgagattacaggcatgagtcactgcacccagcctagagccattcttgatttctctctcttttacctgaacattcacaccagcagcaagtcttggtagctataagatgtacatttccaagtacctctgctagtctccactttcaataccacatccccatccaagccactgtctttcttgcctggatagttgtagtagctcctaactgggctctctgcttccagcttctgcaattcagatgaaccttttaaaacataaatcatatcactttttttttctttgagacgaagtctttctcttgctcaggctggagtgcagtggcatgatcttggctcactgcaatctccacctcctgggttgaagcgattctcctacctcagtctcctgagtagctgggattacaaggacacgtcaccacgcctagctaatttttgtattttctagtagagagggggtttcgccatgttggcgaggctggtcttgaactcctgacctaaagcttcccaaagtgcctgcctcagcttcccaaagtgctggaattacaggcgtgagctgctgcactcagccataaatcgtgtcacttttccacttaaaattttccaagggattccatcttgccagggaagagcatgtcaaaggagaatccaagcgcttttcccgccacctccagttctctgcactcttttttttgtttttgtttttggcgagtaggggagacggagtgtagctgtgtcaccgaggctggagtgcagtagtgcgatcttggctcattgcaacctccacctcccgggttcaagcgattcttctgcctcagcctcccaagtagctgggattacaggcgcccaccaccacgcccagctaattttttgtgttggccaggctggtctcaaactcctgacctcgtgagttgcccacctcagcctcccaaagtgctggcattacaagcgtgaaccaccatgcccggcctgcactcttctttgaacagaactctgttcttgtcctggggcctctacccttgccattcccctgcccagtatgttcctccctgttcttcacattacctgtgccttcctgtcaatcaagatctttgcttctcaccctctctgaggtccaaccctgaacctcaggtcctccaagacagaggcctggggacctgcatgtttaaccagctccccaagtgatgagtgaggtccaggcaggtatggtgtacaccacctccatcccttccatgtatcttaccttcctcttctccaggaagctcagcccggagccagaaacgggaggcccgcctggacaaggtgctgtcggacatgaagagacacaagaagctggaggagcagatccttcgtaccgggagggacctcttcagcctggactcggaggaccccagccccgccagccccccactccgatcctccgggagtagtctcttccctcggcagcggaaatactgattcccactgctcctgcctctagggtgcagtgtccgtacctgctggagcctgggccctccttccccagcccagacattgagaaacttgggaagaagagagaaacctcaagctcccaaacagcacgttgcgggaaagaggaagagagagtgtgagtgtgtgtgtgtgttttttctattgaacacctgtagagtgtgtgtgtgtgttttctattgaacacctatagagagagtgtgtgtgttttctattgaacatctatatagagagagtgtgtgagtgtgtgttttctattgaacacctattcagagacctggactgaattttctgagtctgaaataaaagatgcagagctatcatctcttaaaaggaggggctgtagctgtagctcaacagttaggccccacttgaagggagaggcagaattgtactcacccagattggaaaatgaaagccagatgggtagaggtgccctcagttagcacctgtcccatctcgggccctccaactcctcccagtcccactccagtgcagccagctggctccaaggtagaaacccatgagcactcagggagcagtgtgccttcagctgcagcagaagcagcccggaggataaaatgagaaccagctgcacacgggccctttaactcccaagccccacccctgggcttggcctgccttgccctgccgggaagtgatccccaaggcagggtgagagttccccatctgaggcgtttgttgcagctacctgcacttctagatgtgagtacattgtactagccccccaaaccccaaatcaggggcagatctttgtatcccttgaggctctctttagtcctgtcttgctttgaagggccttgcttctgctggggcagggaaaacatgtctgaatcagagtggggaaggaggatgggtggtggctttgcttttggaggtttcactttccaatagttgggagtcttctgggttttgaagtaaaggcagattaacaccaacaccggtcccccacccccctgcaactctcaggcctctctctgacttcagggtcccacctgggaaatcaggtggggaaccttacagggtcattcagaccccatcttagccctagatcggtgcttgctctactcacctgcactgtcctggggacctgggctctggcctgtcaccttgagctccaagaatgtgacctgtacccattcaggccccttaactctgacagatgagggtttcttactcctccatgcagggctgggccagctgttggtctcagtcgatcattcaggaagtcattagcagagtgatttccagaaggcgtagaatttagtgaccaaggttctttcctttttgggaggagaaagtgaaaactaggatgctcagctggacccaccagcctgagattctggggattttagagctgtcccttggggagccaagcacttgggggtggaggtgatagcgaggctgatggcccctgtgttctcagctctctgcctgggtagcccctgggtgatgggggagaggccagctgtcacgtggggtatcaggtggctctgccagaaactcccttggcacacagagcactgggtcggccctcgggtgtggctgtttgggcaggacagccctctgtatgtagccttgagcaggtaggggggccaccttgagtgggtggcccagagacagcctcagggctccaaggtaacggggtgctcaggttatcttgggtgctgccctcccaggttctgggggagcagaggctgggcgctggcccaacttacaggaaacactcacctttgaactgccattagcaccatctgggcagtacacagccccacccaggtcctctagttcttgttctcggcttagaatctttgtgtttctgcctgagaagccactgcctcctagtttgtggtctctacagttatagccaggttggacttccggctccgtcctttgataactgtgtgctcttgggcaaatttcttaacttgcaggttcttgtgaggataacatgagttaattgagggcacttaacactacctggcacagattaagctcatctgaagtgggagctgttacttaggggcgtttgcctagaacacagggtccagaggctctctcccggaaacttagacccagtgagtcagaagtgaggcctgcaaaaagcagcaggagtggggttaagaattccagcctagggctggatgcggtggctcaggcctgtaatcccagtactttgggaggcccgaatgggaggatggcttgaggccaggagttccagaccagcctgagcaacatagcgagaccctgtctctgtttgtgtgtgtgtggttggggttttgttttttttttttttttaaagaattatagctcagtcctatgattaggcaagttgagaaaatattgatgaagatcaggggtgctgaagcctggttcctggggtcgcttctgatctaggcggttcttgcctctggtgactggtgttaattggcaggagtgggaggagggaggacaagtggaagtctaggctggctgagctgttctgtctcgaaaagttcctaaaactgtgctgctttaaaaaaaaaaaaagtaatttatgagacacattctcaatttccattaatcatctcctaaagggggtaaaccaggaagccgctgggtgaaaacaggctgttggcaattcctgagtcatgtgacccattctctaaagactagaatatttaacttaaatcagtgagaaactctgtgaa

SEQ ID NO: 64 - DNA, 35252 bp, Homo sapiens
aaagggttaatcttccccagggctctccaagcagaagactttgagtagagcactcctcccgcagggatgtcccaccctaaggcaaaggaaaccccaacttttcttcctctccctagaggcagtgcaaggctggccctgagacaggaatgtggcccaattgggcctgcagtgctgagcgccctcttccctcctcaccccaagcctatctcctcctcttccagggtttgccgctgtctctgctattccatcctccccataggggctctctcccctctcccatctcaagatggcagccagcagctctgagatctctgagatgaagggggttgaggagagtcccaaggttccaggcgaagggcctggccattctgaagctgaaactggccctccccaggtcctagcaggggtaccagaccagccagaggccccgcagccaggtccaaacaccactgcggcccctgtggactcagggcccaaggctgggctggctccagaaaccacagagaccccggctggggcctcagaaacagcccaggccacagacctcagcttaagcccaggaggggaatcaaaggccaactgcagccccgaagacccatgccaagaaacagtgtccaaaccagaagtgagcaaagaggccactgcagaccaggggtccaggctggagtctgcagccccacctgaaccagccccagagcctgctccccaaccagacccccggccagattcccagcctacccccaagccagcccttcaaccagagctccctacccaggaggaccccacccctgagattctgtctgagagtgtaggggaaaagcaagagaatggggcagtggtgcccctgcaggctggtgatggggaagagggcccagcccctgagcctcactcaccaccctcaaaaaaatcccccccagccaatggggcccccccccgagtgctgcagcagctggttgaggaggatcgaatgagaagggcacacagtgggcatccaggatctccccgaggtagcctgagccgccaccccagctcccagttggcaggtcctggggtggaggggggtgaaggcacccagaaacctcgggactacatcatccttgccatcctgtcctgcttctgccccatgtggcctgtcaacatcgtggccttcgcttatgctgtcatggtgagccccatgggaccctagcccaggcctgctgtggctcccagcttcccgccagcgctgcaatagagcctctggagtaatcatgccttccttcccctctcctctctgcatggatcccacctccccaattccagggcctttgtttgcctctccctaggacctaaccctctgagccaccactgccctgcccctttgggtgggagggatatggaaacacgtgtcacacagcctcgctgacctgtgccctcctccccctgccccttcactcctccttcctcccttacccgccatctatggggctggcctctctctcttctggatgacttttccacctgatcccttctgggctggcttctcctgaccccggctatgtgcctccacccctcgccctaaccccagtcccggaacagcctgcagcagggggacgtggacggggcccagcgtctgggccgggtagccaagctcttaagcatcgtggcgctggtggggggagtcctcatcatcatcgcctcctgcgtcatcaacttaggcggtgagtgggggcttgggacaggcaggggaggaatggaagggttggcaagggcagctttactaacccctgcccctgctctctcctgtctgtcctccttacctctcctttgtctctccttgtctccccctccccccgtctgtccttccctctcctctcccacagtgtataagtgaggggctctgccccgcatcccaagacttttcttcctgttgggagctgccttgggcccatccctcccctggggggagcccaactgatggccctggcccccacccctaaggaccaagggagcctgagcggccttgtttacagcttctgtcctgctcctgcatcttgccaggctcctctgccaactgtaggcctgcctcatccctgcactggttccaacctccctgcactaatgcctgcatcccctccggcctcttggccccctatccctgcacttctggaaacctccctgcactctggaaacctccctgaacacctccccaactctgcgctctcagcctccctgcatctctcctggcctccctgcacttcttccagccccccaaattctctggacctccaccctggccgcctcctcccaactttcattgtcttggcatctctcaaccctcagtcctctcttccttcccttctttatcatctcccctttcctctccacgtcccgcccccttcctcttcctgcctcctcatctcccttaagcatcctcttctccaacctcccgtcaccgtttactctgcaaaattgacagcacttagacgaggcttgggggcagggagcagtgttgggagagggctccccaaccccaggctcggactgttctctgctgggaccacccagggtcggacacccaagggtgcctggcaggtcgcagagttggcaagccgggcctcgtatggggactcgggtgagggtggcgagtactggttccgaacgcacgcaggggagaagggagggacgcggcgctgacccttccaggtcagctggagttgacccgcccacctgggcttttcaaccccagtccgcgagtttctttcttgaaggtgtgggggctagattcattcacgtgcttcgtaatgaaataatccaaaaaataggaccaaagcgcccactggcaggagcgagggcggggcgccgcgctctataattattttctaagatgatgggggaggtttgttgcacgcgacagcccgctgaggaggcggggaccgagctacaacgcggttcggatttggcgggggtttttttccttaaaaaaaaaaaaaaaaaaaaaaaaaaagtctgggggaagaaaaaaactaaaattcttaaaaaaaaaaaaaaaaggctattatcaaactgatttctccctttttgtatgccggatgctgcatgagtctgaaacaccaataaacggagactgcatgagactcgcctccaatctcggttggttcctgcgttcgtcccgccggcccggcggtgctgcctttctggcagaaccttactgggtggtatacgcatgcgacttcccggtggccatctttactgtgggctgaagcctgtgcgcttactcgcgcatgtgcaagccttccctcgctttcctcttccaagtagccttgcctagagcggagcctcccgcgccatttctgtgcgcctgcgtagcgtgaccctgcgcagcctgggaggcgggtcttagctccaggtgcgtacggcatctgacttgacgtggcccacaactgaaaggtctggggagaaggcgccgtgtccgggtgtggagaggggcgtcgtggaagcgagaagagtggcccgtccctctcctccccctttccctctttcggaaagtggtttctgcggggcccgggagcctcggagtaccgaacctcgatctccggggcggggtccttggtggggactgagcgccccctcccggggacgggcggtctggccgcggagtcccctgcgggagcgtgattggctggaaacggtcccgaacccccaggggagcccgatccctgggggaccctggcttcggactccagtatctgtcgtcgcagggtccctgccctagtggcctatgtcccttgctcggggccatggagacactgcggccagtacggcggcgcctctgtctgaagaaggggaagtgacctccggcctccaggctctggccgtggaggataccggaggcccctctgcctcggccggtaaggccgaggacgagggggaaggaggccgagaggagaccgagcgtgaggggtccgggggcgaggaggcgcagggagaagtccccagcgctgggggagaagagcctgccgaggaggactccgaggactggtgcgtgccctgcagcgacgaggaggtggagctgcctgcggatgggcagccctggatgcccccgccctccgaaatccagcggctctatgaactgctggctgcccacggtactctggagctgcaagccgagatcctgccccgccggcctcccacgccggaggcccagagcgaagaggagagatccgatgaggagccggaggccaaagaagaggaagaggaaaagtaaaggcacacccttacaccttgtcccggggctgctcccctgatggcgggaggaaatagggaggggaaaatgtgggacgctggaacctttgaaagtggagggagggaagccagcgggggaggaggaacgggcaggggagaagcacacgtgtgggtgggagggaggaccgccctcacccttaactatgttcacctgtcccagaccacacatgcccacggaatttgattttgatgatgagccagtgacaccaaaggactccctgattgaccggagacgcaccccaggtacaaacgaagaggaaacagttgggggaggtgaagggcctcggctcagttacccaagatcggctcccctagaggcctttgcttgctgcctcagctcccacacaacttacagctgcaggagagagtattcacccagtagcaccatctttatgacttagattactaccttgtcttccttttttttttttttttttttttgagatggagtcttgcccttgtcccccaggctggagtgcaatggcacgatctcaactcactgcaacctccgcctcctgggttcaagcaattctcctgcctcagcctcccaagtagctgggattacagacgcatgccaccactctgggccaatttttgtatttttagtagagacaggctttcaccatgttggccaggctggtcttgaattcctgaccttgtgatccgcccacctcagcctcccaaagtgctaggattgcaggcatgagccaatgcgcctggccccttgtcttcctttaagagacaattataatacaaaaaattagccgggcatagtggcgggcacctgtagtcccagctactcaggaggctgaggcaggagaatcgcttgagcctgggaggtggaggttgcagtgacctgagatcacaccactgcactccagcctgggcgagagagtgagactccgtctcaaaaaacacaattacagataattctttttttaaaaaaacaactagtcattgattctggaaaattacagataattctatcatgtttcccattcccagaagtccaagtcctggcctttcaatattatctagatctgcatccctctactaccatgtacattctttaatcacaccgctggccccatttcccaccccacatgccttcctagaatttaccctcagagtcatgcctttccttttttcttttttttgaggggtggagagacagagtcttgctgtgttgcccagactggttggtctcgaactcttgagctcaagtgatccatccgcctcggttctcaaagtgctgagattacaggcatgagtcactgcacccagcctagagccattcttgatttctctctcttttacctgaacattcacaccagcagcaagtcttggtagctataagatgtacatttccaagtacctctgctagtctccactttcaataccacatccccatccaagccactgtctttcttgcctggatagttgtagtagctcctaactgggctctctgcttccagcttctgcaattcagatgaaccttttaaaacataaatcatatcactttttttttctttgagacgaagtctttctcttgctcaggctggagtgcagtggcatgatcttggctcactgcaatctccacctcctgggttgaagcgattctcctacctcagtctcctgagtagctgggattacaaggacacgtcaccacgcctagctaatttttgtattttctagtagagagggggtttcgccatgttggcgaggctggtcttgaactcctgacctaaagcttcccaaagtgcctgcctcagcttcccaaagtgctggaattacaggcgtgagctgctgcactcagccataaatcgtgtcacttttccacttaaaattttccaagggattccatcttgccagggaagagcatgtcaaaggagaatccaagcgcttttcccgccacctccagttctctgcactcttttttttgtttttgtttttggcgagtaggggagacggagtgtagctgtgtcaccgaggctggagtgcagtagtgcgatcttggctcattgcaacctccacctcccgggttcaagcgattcttctgcctcagcctcccaagtagctgggattacaggcgcccaccaccacgcccagctaattttttgtgttggccaggctggtctcaaactcctgacctcgtgagttgcccacctcagcctcccaaagtgctggcattacaagcgtgaaccaccatgcccggcctgcactcttctttgaacagaactctgttcttgtcctggggcctctacccttgccattcccctgcccagtatgttcctccctgttcttcacattacctgtgccttcctgtcaatcaagatctttgcttctcaccctctctgaggtccaaccctgaacctcaggtcctccaagacagaggcctggggacctgcatgtttaaccagctccccaagtgatgagtgaggtccaggcaggtatggtgtacaccacctccatcccttccatgtatcttaccttcctcttctccaggaagctcagcccggagccagaaacgggaggcccgcctggacaaggtgctgtcggacatgaagagacacaagaagctggaggagcagatccttcgtaccgggagggacctcttcagcctggactcggaggaccccagccccgccagccccccactccgatcctccgggagtagtctcttccctcggcagcggaaatactgattcccactgctcctgcctctagggtgcagtgtccgtacctgctggagcctgggccctccttccccagcccagacattgagaaacttgggaagaagagagaaacctcaagctcccaaacagcacgttgcgggaaagaggaagagagagtgtgagtgtgtgtgtgtgttttttctattgaacacctgtagagtgtgtgtgtgtgttttctattgaacacctatagagagagtgtgtgtgttttctattgaacatctatatagagagagtgtgtgagtgtgtgttttctattgaacacctattcagagacctggactgaattttctgagtctgaaataaaagatgcagagctatcatctcttaaaaggaggggctgtagctgtagctcaacagttaggccccacttgaagggagaggcagaattgtactcacccagattggaaaatgaaagccagatgggtagaggtgccctcagttagcacctgtcccatctcgggccctccaactcctcccagtcccactccagtgcagccagctggctccaaggtagaaacccatgagcactcagggagcagtgtgccttcagctgcagcagaagcagcccggaggataaaatgagaaccagctgcacacgggccctttaactcccaagccccacccctgggcttggcctgccttgccctgccgggaagtgatccccaaggcagggtgagagttccccatctgaggcgtttgttgcagctacctgcacttctagatgtgagtacattgtactagccccccaaaccccaaatcaggggcagatctttgtatcccttgaggctctctttagtcctgtcttgctttgaagggccttgcttctgctggggcagggaaaacatgtctgaatcagagtggggaaggaggatgggtggtggctttgcttttggaggtttcactttccaatagttgggagtcttctgggttttgaagtaaaggcagattaacaccaacaccggtcccccacccccctgcaactctcaggcctctctctgacttcagggtcccacctgggaaatcaggtggggaaccttacagggtcattcagaccccatcttagccctagatcggtgcttgctctactcacctgcactgtcctggggacctgggctctggcctgtcaccttgagctccaagaatgtgacctgtacccattcaggccccttaactctgacagatgagggtttcttactcctccatgcagggctgggccagctgttggtctcagtcgatcattcaggaagtcattagcagagtgatttccagaaggcgtagaatttagtgaccaaggttctttcctttttgggaggagaaagtgaaaactaggatgctcagctggacccaccagcctgagattctggggattttagagctgtcccttggggagccaagcacttgggggtggaggtgatagcgaggctgatggcccctgtgttctcagctctctgcctgggtagcccctgggtgatgggggagaggccagctgtcacgtggggtatcaggtggctctgccagaaactcccttggcacacagagcactgggtcggccctcgggtgtggctgtttgggcaggacagccctctgtatgtagccttgagcaggtaggggggccaccttgagtgggtggcccagagacagcctcagggctccaaggtaacggggtgctcaggttatcttgggtgctgccctcccaggttctgggggagcagaggctgggcgctggcccaacttacaggaaacactcacctttgaactgccattagcaccatctgggcagtacacagccccacccaggtcctctagttcttgttctcggcttagaatctttgtgtttctgcctgagaagccactgcctcctagtttgtggtctctacagttatagccaggttggacttccggctccgtcctttgataactgtgtgctcttgggcaaatttcttaacttgcaggttcttgtgaggataacatgagttaattgagggcacttaacactacctggcacagattaagctcatctgaagtgggagctgttacttaggggcgtttgcctagaacacagggtccagaggctctctcccggaaacttagacccagtgagtcagaagtgaggcctgcaaaaagcagcaggagtggggttaagaattccagcctagggctggatgcggtggctcaggcctgtaatcccagtactttgggaggcccgaatgggaggatggcttgaggccaggagttccagaccagcctgagcaacatagcgagaccctgtctctgtttgtgtgtgtgtggttggggttttgttttttttttttttttaaagaattatagctcagtcctatgattaggcaagttgagaaaatattgatgaagatcaggggtgctgaagcctggttcctggggtcgcttctgatctaggcggttcttgcctctggtgactggtgttaattggcaggagtgggaggagggaggacaagtggaagtctaggctggctgagctgttctgtctcgaaaagttcctaaaactgtgctgctttaaaaaaaaaaaaagtaatttatgagacacattctcaatttccattaatcatctcctaaagggggtaaaccaggaagccgctgggtgaaaacaggctgttggcaattcctgagtcatgtgacccattctctaaagactagaatatttaacttaaatcagtgagaaactctgtgaagttgtgtccttgtttataccaaacttcatgtgccttttcctgaacctgaagctgtgggaaggtctgggggcagggccgcatcaccgaccttacgtccaacctcaggactgcctggagcaagagccctggggttggggacaaaggaggctgcctggacctgggtaagggaaggggctggaggagaatgagtgcaattccctgcccttcacagcctgcaatcggagctgtgtttttgtttttgagacagagtctcgctctgtcccccaggccagagtacaatggcgcaatctcgactcactgcaacctctgcatccctggttcaagcaattctcctgcctcagcctcccgagtagctgagactacagttgcctgccaccatgtacggctaatttttgtatttttagtagagacgaagtttcaccatgttggccaggctggtctcgaactcctgagctcaggcaatccgcctgccttggcctcccaaagtgctgggattacagccactgcgcccggcctgaaactgatctttatcctcctcccagttcctactgtgcaccagagaccctccagtctctaatacctttgacttgaagagcagtcatttttttttccttttcttttcttttcttttttttttttttttttttgagatggcctcactcttgcccaggctagagcgcactcgtgtgctccatttacggctcactgcagccttgacctcccaggcacaggcgatcctcccacctcagcctccaaagtagcagggaccacaggtgtgcaccaccacacctagctaatattttttatggtttttatagagacagggtctccctatgttgcccaggctggtcttgaactcctggcctcaagtgatcctcccatcttggtctcccaaagtgctgggattacaggtgggagccaccaagcctagtcaacagtcacttttattctcacttcactggagaggaaggctcagaggctagtaagtggcccaggagcatgctggcagtgataaaacctgctggagtgacattttcccactggctctcaatcctggatatatattaagagtcagaggccaggcgcggtggctcacgcctgtaatcccagcactttgggaggccaaggcaggcggatcacgaggttaggagatcaagaccatcctggctaacacagtgaaaccccatctctactaaaaatacaaaaaaaattagctaggcgtggtggtgggtgcctgtaatcccagctgaggcaggagaatggcatgaacccgggaggcggagctgcagtgatccgagatcgtgccactgcactccagcctgggtgacagagcgagactcgtctcagaaaaaaaaaaaaaaaatgagggagaactttttacaatagcaacgggtgaacctcacccagaccaattaaatagaatcaccggagatgggtggctttaaaaaaaggtctccagaaggcctggcgcggcagatcacacctgttatcctagccctttgggaggccgaggtgggtggatcacttccagcctgaccaacatggcgaaaccctgtccactaaaaacaaaattatctgggtgtggtggcggacatctgtaatcccagctacttgggaggctgaagcaggagaattgcttgaactcgggaggcagaggttgcagtgagccgagatggctacactccagtctgggcaacaagcacgaaactccatctcaaaaaaaaaaaaaaaaaaaaaaaaaaaaaacagatttccagatgaccagtgtgcagcccgagccgagagtctgctttagaccagagctgctcagactgtaatgtgcatgcaagtcattgagggtcgagttaaaatgccagtagattcagtggctctggggtggggccccaggctgtgttgctatcaagcctccaggtggtaccactctactcactgcagaccccgtaggcagtgtggtcacttggtcaattgccatttaagactcactaggggccaggtgtggtggttcacgcctgtaatcctagcactttgggaggctgaggcaggcagattgcctgagctcaggagtttgagaccaccctggggtgaaaccccatctctactaaaatacaaaaaattagccaggcttggtggcatgtgcctgtaattccagctactcgggaggctgaggcacgagaattgcttgaacctgggaggtaggtggacgttgcagtgagccgagattgtgccacttcactccagcctgggctacagtctccaaaaaaaacaaaaaagagattcagtatatcagctactcacagttgaccctgaagatctctgggaagtagtgactcatgactcgtttatttattaagttttgctgtagcagaagtttacttttgagccaagagtctgatccggtctccctcttttttttttttttctttctttaaagagatggggccttgctatgttgcccaagctggtcttgaactcctggcctcaatccatcctcccaccttcggcctcccaaagtgttgggattacaggtgtgagccacctctctcaggcaagagcccctcttttaactagacaatgaacctggtttctgctttggacaggctatttagttcctgcttatttaccctcatggtgggagagaccctggtgggatttggggtgaaagctggctgtggttcttgcaggagcctcatgacacctgagggaggtgtgatcaggcaagactgggcctctacactgagagccgactagggcaggtctcagaagcagagactgaaggaagttgggtggatgagtggatctggggagcaggggccaagcctgagggctgggcagagccttccaaaggtcaacacaatccttgctattgtcttttgagggccctgatctattttaagtaaaatgctctaactgcgcatgtcatctggaaggaaaccacaaaaaactcaatctgagacttgtcaccaatgtgctgcctgagtcaaagggtttccctggctcacctccatagatggcgagggtagaaggcaagacctgtcctgggtggtctaggcagaaggcccaggtttagggcatggcaggtgggtggtcagggaggtgaggtggggtcctggtgctgatgcaggggcagttgccgagggcttggcctcagaacaaggcaggagtccagccatgaggatgactcttgctgagtcactgagctgggcgaggcattcagaccccctgactgggcccagctggggcggcagatggtggagaggcctcagctgtggggggtgttggggagattatccactgatgaaccaaatggaggctgttcccagagcctgcttccaaccttgcacggccttctagagttcaaatctttcctgggggggcctcagagccctgtccatacctccgctcacagccccagcccttcctcttctcccatctggtttcctggccaggtttcggccctgcggagaaccctccaagggagcagtggaaaaagcttcacttggcagtaaagcccctacttgctgttccatccctgcagctggggtgaaataagccactgaccagtaaacaactgaggcttaaaccagcatgccagctcaggtggggagcccccagcactggttatattccctagattcctcactggataggaaagttgggcctcaggcactcttccctcctctgcagtcaaacagtgcagatgaagagccaggctctgttcccagtgctttatgtgctaacttggttgataatgttatccattctcattttgtagatgaggaaacaggcacagggtggtcaagggacttgttcaaatcactgatcccataagggtgagagccaagatccaggcatcctggctgggtgcggtggctccacctgtagtcccagtgctttgggaagctaaggctggatgactacttaagaccaggattttgagaccagcctggacaacaaagaccttatgcctacaaaaaattaaaaattagctaggtgtggcagtacgtatctacagtcccagctactcgggaggctgagatgggaggatcccttgagctgaggagttcaaggctacagtgagctgtgatcactgcactccagcctgggcaacaaagtaagaccttatctcaaaaaaaaaaaaaaaaaaaggccgggcgtggtggctcacgcctgtaatcctagcactttgggaggccgaggcgggtggatcacaaggtcaagagatcaagaccatcctggtcaacatggtgaaaccccgtctctactaaaaaaaaaatacaaaaagttagctgggcatggtggcaggcgcttgtagtcccagctacttgggaggctgaggcaggagaatcatttgaactggggaggcggaggttgcggtgagccgagattgcgccactgcactccagcctggcgacagagtgagagtccatctcaaaaaaaaaaaaaaaaaaatccagatctaggcattcccagccctctggactctaggaagtcgtctttccagaacagagccccgtattgtggagcaactggggggtggaatcaaaggtgagcaggacagggctataggaagaaaagacaaggtccccataagagtggcgagaggaacagagccaggacatcggaaagcaagcccctgtgttcccaaaccgcagaagagggagctctgatgttagacaagccaccctcctacaagcgaagggaaagtaactttgagcaaaaatgagcaacagaaaatgagatcaaggtcagatctcatacaaagttgcaagatgaaagaatgagcagcagaataacctccctgtgatgtggaaagtgtgccaggaaaacagacccaaactgtaacctctttcagaatgaggcaaggcagtgaggaaactatgtgaaaacacgaaagcagccgatcagagttgtaagcccgggcagtctgggttggaatgggtgccccgagccacgggaccatgatgcctctctagaaagacaggaccaggcattccaccagggttctagtcccaacagcaccactaacttgcttgtggccctaaaggattcattgtccctctctgggtctcaactatttagagctctactgtccagtatgggatcaaccagccatatttggcaatttaaattaaaattagctgggtacggtagcgtacccctgtaatctcagcactttaggaggctgaagcgggaggattgcttgagcccaggagttcgagaccagcctaggcaacatagcaggaccttgtctctgcaaaaaaaatgaaaaaattagctaggcgtggtggcacatgcctgtaatcccagctactcgggaggctgaggtgggaggatcacttgagcctggaggttgaggctgcagtgagtcatgattgtgccactgcattcctgcctgggcaacagaacaagaccttgtctcaaaaaataatttaaaaatttagttcctcagatgcattagccacattttattttatttttttccaagacagagtcttgctctgtcgcccagggctgtagtgcaatggcgagatcttggctcactgcaacctctgcctcccaggttcaggcaattctcctgcctcagcctcccaaatagctgggattacaggcacgtgccaccatgcccagctaatttttgtatttttagtagagacagggtttctgcatgttggccaggctggtctcaaactcctgaccttgtgatctgccgacctcagcctcccaaagtgctgagattacaggtgtgagccagcatgaccggccattagccacattttaagtgttcaggagccacatgtggatgtggctagtccaaagacagcacagatttagaatattctcatcattgtagaaagctctattggacgctgctgagtaaaagggtttttttggtttggttttgagattggagtctcgctctgttgcccaggctggagtgcaatggcacgatctctgctcactgcaacctctgcctcccaggttcgagcaatcctcctgtctcagcccccctagtagctgggattataggtacccgccaccacaactggctaatttttgtatttttagtagagacggggtttcgccatgttggccaggctggtctcgaactcctgacctcaggtgatccacctgccttggcctcccaaagtgctgggattacaggcttgagccaccacgcccggccaagttaaagggtttttaaacaagagctgggcagtgcaatggcatagctgtaaggcagcagggggtggtggggactgtggtaggtgggaaagcttgtgttccatctaaatggggcagctgctgcttgactgtaggctgtattgctggtcttctaattcttcaagtgaatcaggaattgggattttgtgaagactcacaatttctaaacaaaaagttgaagttttacagatcgtggggctcaagtataactcctcttgggctgtatccagccttgattctgtaatctgtggctcctgcctgtttttcctcggccaggccactcccttcttcccctcacttatatttttcacctggggttggaggctgggtagatggtggaattgatgaggaaccacttttttttttttttttttgagatggagtctcactctgcctctcataatgctgggattacaggcatgagccactgcacctgtcctggccagacatttttgaggccaccaccagacaaaagaggctcctcatcggccaggtgtgatggctcgcctataatcccagcactttgggaggcagaggcaagaggattgcttgaggccaggaattcgagaccagcctaggcaacataatgagacctcatctctccaaaaaaaaaaattagctagacatggtggcatgtacctgtagtctcagctacccaggaggctgaggcatggcttttgtgagctatgattgcaccactgcactccagcctgggtgacagagtaagactccgtctcaaaaaaaaaaaaaaaaaaaaaaaagtctgacctgagtctcttaaggatgaggctctggagcacctagtaaacttggtcccatttgtgtgactcaaagggacatgtccaaagtccaaagtgctgggggcaggggtggggcttaggtagggcatgtgacattcctgaacaggccaagcactgggtgaaactactcaggattcagaagcaggtgggatgggtgggtggaacatgataatcatcccccttctccttcctttccaccctacccttgctcacaactgcaggagctgaggatgggagagaactggggacgagggggccagagtgatttgcagtgttagtaatgcagctggttctatggaaggctcagttccatctgggatccctttatgagcagtggactaggtcttcacattcagcccaggattactaaagcataggaaagaggcagggaacatagacacagctcatgtaaacattccttttgtttatggccgaatcctagccactggactacctgaggcatacagatattctttggctatgggctgacatttgaatacagctggggcctcaggattctctgaaataaagggctgcctccctctggaggagccaggcagctcctcagagcagctgcccattgcgtgctggacaaggccatgtcaccacctccatggctccccagtttcccagcttgctgtatctctccaccgtaagagactgggagcaccttgatctgaagctctttgcagtgccggtggcagtgtagggggaagtagttgatgggagtgagggaaaggaattggcaaggaaccctgggcctctgtggctcactgcatcaagcagttcttggcaaaggtaaggtcaggatgggctgtgtcgtcttgggtggggtgaagacagggagcagtgggcatgcagatgcggacagggaagggtgcagtggcctggctggaggaggtagggccgtatcccacccagagtctgtcaccagattcatgcctgccccaccccaggctccccaggttcatcctgtgtcgtctcccccacctaccagtcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagaggtgggtgtgggggctgggctgtgggggatccttggggatgtgggggcctgtttggctggcatgatggtccttatcctcctccctcttcccaagcaggagtggccctcgcttgggcgatagagaggtttctctctcatttggtgtcctctttggtagtggagacctggtcccaggtcctcacacctcttctcatcttcctgcagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggtacctggtttcctcactccctatgccccaccctacctgtcctccacctgccttgggctctatactgctgccttcttcttctttttttcttttcttttttgaggcagagtttcactcttgtcgcccaggctggagtgcagtggcataatctcggctcactggaagctccacctgggttcaagtgattttcctgcctcagcttcctcagtagctgggattacaggcacccgccaccacgcccggctaatttttgtatttttagtagagacagggtttcaccatgttggccagtctgatctcaaactcccgaccccaggtgatccacctgcctcggcctcccaaagtgctgggattacaggcatgagccactgttcccggcctgtaccgagttctaaagggaaaacaaaccagggcagtgggaggggtggggagagacacttgctggctctcaccaagggtggaattgactcactgtacctccactcacctccagccacccccatcctccacacatgccccaaacacacctgcctcttttctgagaactgttggcccatctcaccttcccaggctccagagcctaccagaagtgcccagccagtctggcattaaatgacatgtgccaaggttaagcagttcattcacccggtgccagacactggtgggcagtgccaaagcagcagtgacaagcccaggccccaggctgtgcctgttctaggagaagccatcacaggcctgaacctacagccaggctcttgtccccgttggcctcaggcctgggcctgagcaggtgggtgtcccaccttcattcctttacctgttcttccacctttaccttctggccatttaatggttttgggttttttgtttgtttgtttgtttgtttttaatagagacggggtttcaccgtgttagccaggatggtcttgatctcctgacctcatgatccgcccgcctcggcctcccaaagtgctgggattacaggcatgagccaccgtgtccagccccatttaatggttttcttactgactttactaaccagtgctgcttgatcctgaaagcataatagcagaacatggggaacttttagagacattcatgtccacttaggtgcagacagtttgggggaagaagtgtgtgtgtagagagaaaatgaagaatgattaagacaataacccttaaggaatccaagtgaaaagtatatagggattcttgtacctttttttttttttttttttttttgagatggagtctcactctgttgcccaggctggagtacagtggcataatctcggctaactggaagctctgcctcccaggttcacgcaattctcctgcctcagcctcccgagtagctgggactacaggcgcccaccaccacacccggctaactttttgtgtttttagtagagatggggtttcaccgtgttagccagggtggtctcgatctcctgacgtcatgatccacctgccttggcctcccaaagtgctgggattacaggcgtgagccaccgcgcctggcctttttttttttttttttttctggatctccccctgttgcctagacgagagtgcagtggggtgatcatagctcactgcagcctcaacctcctgggctcaaacgatccttccacctcattctcccaaaatgctgggattgcaggtgtgagccaccaagccctgcctaagctttcattttaaatatgttcagccgggcacagtggctcacgcctgtaatcccagcactttgggaggccaaggtaggcagatcacttgaggtcaggagtttgagaccaggctggccaacatggcgaaaacccatctctactaaacatacaacaattagccaggcgtggtggcatgcgcctgtaatcccagctacttgggaggctgaggcatgagaattacttgaacctgggaggcggagattgcagtgagctgagattgcgccactgcgctccagcctgggtgacagagcaagactctgtctcaaaaaaaaaaaaaaaaattagctgggggtggtgacacacctgtaatcccagccactcaggaggctgagacagaaggatcacatgagcctgggagattgagactgttgtgagccatggttgtaccactgcagtccagcctggatgacataggaagaccccatctccaaaaataaaaaaaagccagctcttcctttgagccccagtttcagttcaaagggccttctctaacttctccttcatctgaactcctgagacagggtcttgctctgctgcccaggctgaagtgcagtggtgcagtcatagctcactgaagccttaacctcctgggctcaagtgatcctcccacctcagcctcccgagtagctgggactacaggtgtgcgccgccaccatgcctggctacactttttttttttttttttttttttagagatgggatcttgctatgttgcccaggctggttcttgaatgtctgaggtcaagcaatcctcctacctcagtctcccaaagttctgggatgacaggtgtgagccactgtgcccggcctccaccccagtcttatttcaggacatacagagatggatgttgtggacccgcctccagagcatcaggcttggccctggggtcacagcactgatggttctgtgtctccaccttcttccccactaggacatcacacccctgcaggtggttctgcccaacactgccctccatctaaaggcgctgcttgattttgaggataaagatggagacaaggtggtggcaggagatgagtggcttttcgagggacctggtaagttctgtctccatagggctccctgccttcctgtcatagccctgataccttctgaccatcaccttccctccccaggcacgtacatcccccggaaggaagtggaggtcgtggagatcattcaggccaccatcatcaggcagaaccaggctctgcggctcagggcccgcaaggagtgctgggaccgggacggcaaggagagggtgacaggtggggtcaccaaggggcgatgatggtgggtgggcaggaggggtccccactgcaggggaagcaggggaaggttgaggaaagcctcctgtagccccagagaggcgctttcctggtatcttttgaaagctgttgagggccacccactgctcttccttccccacccccgcttcatgctgtttccacttgggctggaaaatgtgaccatgaccatgcggatgtggcttttccttccctcaccttcaccatgagctgtgggcagtggccatgacttacctgattctggatcaacaaagaagatgttcaaatacaattgacaaatgtaggccaataggtacagtggctcacacctgtcatcccagcactttgccaaggtgggtgaatcgtctgagcccaggagcttaagaccagcctgagcaacacagtgagaccccatctctacagagaatttaaaaattagcctggccttggacacacacctgtggtcccagctactcagaaggctgaagggggagaatttcttgagcccaggatgtggaggctgcagtgagctgtgactgcaccactgcactccatcctgggccacagaggtactaccccgaggtgctaccattcccactttttttttttttttgagacggagtcttgctttcttgctgttgcccaggttggagtgcagtggcgcgatctcggctcactgcaagctccgcctcctgggttcacaccattctcctgcctcagcctcctgagtagctgggactacaggcgcccaccaccatgcccagctaattttttttttttttgtattttttttttttttttttttagtagagacagggtttcaccatgttagccagggtggtcttgatctcctgacctcgtgatccaccaggttcggcctcccaaagtgctgggattacaggcgtgaaccaccgcacccggccattcccactttctatatatcaaaactgggatgcagaatgcaggttgcttgccctggggtgtggccaggcagggcgaggctgggacctgcatccaggcactctggcttctccagtaaaccaaaggacatccacaactctaacagaggcagttctgctgcctgttttagcagaaggacaaaagttggtctttggagcttagagaaggcagaacaggctgttggcatagcagcaacttgggcatcttaggaggccaaggtgggcggatcacttgaggccaggagttccagactagcttgggcaacatggtgaaacaccatctctacaaaaaatacaaatattagccgggcgtggtggcacgtgcctgtaatcccagctactcaggaggctgaggcatgagaatcacttgaatccaggaggctgaggttgcagtgagctgagatcacagcctgggcaacagagggagactccgtctcaaaaaaaaaaaaaaaaaaaaaaaaacttttaaaattcaactggggtgggggtttggcctcaaaagaatgaataagaggaccgcagtcaggaacttgagcctggggtcagtgctatctttttgcctatgaaatctgtcaatcccctgtgtctaagctgtgggggaggggtaggtggggagcaggctggggggcccttgtcccttaccctccactcttggcccaggggaagaatggctggtcaccacagtaggggcgtacctcccagcggtgtttgaggaggttctggatttggtggacgccgtcatccttacggaaaaggttggtgctctgggggctgtggtttaagggacctggggctagggaaccctccgagtggcagagaatggtggtagaatggcatgagagtaaaagagaagcaataattttagggtcacttaaaaaaattcagagatcagattgcctgagtattctggatcatctgaagggttaaatagtctttctggggctgggcgcaatgactcacatctgtaatctcagcaatttggaaggctgaggcaggaggatcacttgaggccaggagtctgagaccagcctgggcaacacagtgagaactcatcgctacaaaaaatttaaaaattagctgggtgtagtggagcatgcctgtaattccagttactccagaggcgctgaggcaggagaatcgcttgaaccccagaggcagaggttacagtgagccatgatcatgccactgtgctccagcctgggcaacagagcgaaaccctgtctcaaaaaaaaaaaaaaaaaacaaagccggtcgggtgcagtggctcatgcctgtaatcctagcattttgggaggctgaggtgggaggatcacctgaggtcaggagttcaagacaaacctggccaacatggcgaaaccccatctctactaaaaatacaaaaattagctgggcatggtgtcacccacctgtaatcccagctgtactcaggaggctgaggcaggagaatcgcttgaacctaggaggcggaagttgcagtgagctgagatcgcacctttgcactctagcctgggcaacaagagagagactccgatttaaaaaaaaaaaaaaacaatccctggattggtagaaattgtctctgagatctgggagcattgggagcatttggtggccaatggggctcgcagatcccctgaagttggaggcaggtcactcaaatacccaacatgttgctctgcagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaaggtgaggtccctacacccccacagaggactgccctgggagatgtatgtcctctagtggcatgaggccctctgccttctctcctccagacgcacgttctaggaacaccttctgtgcctttgcatgcttagttcttacacacctgagacactggcccatttgattcctggcagcctctgacttacccctcagacctgaagttaattccccttctgggaaggcctcctggctacccgctgcctgagactctgaaactctgatacagtcatgcgccacttaatgatggggatacattctgagaaatagtccttagatgattttgtctttgtgcaaaagagtgcacttatgcaaacctagatggcacctagtctagatggcgtagcctgcccctaggctgccaacctgtgcagcatgtgactgtcctgaatactgcaggcagctgaacacaatggcaagtacttgtgtatctagccatagaaaaggtaaggtaaaaatacaatataaaagcttcgttataggccagcacagtggctcatacgtgtaatcccagcactttgggaggccgaggcaggtggatcacttgaggtcaggagttcgagactagcctggccaacgtggggaaaccctgtctctactaaaaatacaaaaattagccaggtgtggtggcacacacctgtaattccagttactcgggaggctgaggcacgagaatcacttgaaccctggagatcaagcctgtggtgagccgagatcgtgccactgcactctagcctgggcgatagagtgagactctcagaaaaaaaaaaaatctccattataatcttacgggaccaccatgtgcagtctgtaatggactgaactatcatgcagtgactatatttcacatctttaatatcctggtgttcactttgctttgtcatcttttgtaaaataaacctcttggtttaccctctcccaccccctacttcatcccctctctgaactatatgtgggaataccagcagttgccaaactcattctgtaaagggggctggatggtagatactccaggctccgtgagtcattgtttctgtggaagttcttcaactctgctgttatgtcaggaaagcagcttgggcactacgtaaacaagtgagtactgccatgctcctggaatagtttatctgcaaaaacaggaggcagaaaaagtagaaataggccaggcatggtggcttacatgtgtaatcccagcactttacgagtccaaagcgggtggatcgcttgaggtcaggagttagaaaccatcctggccaacatggcaaaaccctttctctactaaaaatacaaaaaaattagctgggcatggtgtcaggcacctgtaatcccagcttctctggaggctgaggcaggagaattgcttgaacccgggaggcggaggttgcagtgagccgagatcacaccactgcactccagcctgggtgacagagcaagactgtctcaaaaaaaaaaaaaaattagaaataacccaaatgtacatatataatgaatggataaaaaattgtagcatatccatacaatggaatatcattcagccataagaaagaaatggcaggccaggcgcaacagctcatgactataatcccagtgctttgggaggccgaggcaggaggattgcttgaagccaggagtttgagaccagcctgggtaacatagtgagaccccatttttacaaaaacttttaaaaattgaccaggcatggtggcacacctgtagtcccagctatttgggaggctaaagtgggaaaatcgcttgaccccaggaagtggagtgtatagtgagctatgattgtgccactgtactccagcctgaggcagtagagtgagatcctgtctctaggaaaaacaaaaaataatgacatacgtgctacaacatggataaaattgaaaatgttatgctaagtgaaagaagccagctggacgcagtggctcacgcctgtaatcctaacactttaggaggctgaggtgggcacatcacctgaggtcaggagttcaagaccagcctggccaacatggtgaagccccgtctctgttaaaatacaaaaattagctagcatgatggcgggtgcctgtaatcccagctactgctcgggaggctgagacaggagaatctcttgaacctggaagacagtagttgcagtgagccgagatcccaccactgcactccagcctgggctgctgagccgagactccatctcaaaaaaagaaaaagaaaaaagccagacatcaaagaccacatattgcatgattccatttatgtgaaatgtccagaataggtaaacacataaagaaaatagactagtggtgggtggggtaggtggggagtggcagtaacttctaggtacaggatttcttttcagggtgatgacgaaaatactctagacttaacatagcagtgatggttggacaactttgagtatactaaaacaactgaattgtgaattgtatactctagatgggaaaatttcatatgtggattatatctcaaaatttttttaagaaacaggcggtgctgggcgtggtggctcacatctataatcccagcactttggaaagctgaggtgggtagatcgcttgagtctaggactttgagaccagcttaggcagcatggcaacaccccatcatctacgaagcacacaaaaattagctgggtgtggtgatgcgcatctgtagtcccagctccttgggaggctgaggtgggaggattgcttgagcctggaaggttgaggctgcagagagctgagatcatgccactgcactatccagcctgggcaagagaggaagactatctcaaaaaaaaaaaaaaaaaaaaaaaaaggcagaatccagatttggcctgaaaaccagagtttgtcaagccctaggttacaccatctctagaaaacaaagcctgggagaaagaagaaaaaacaggttgatttttaatggtttagcttgcgtggatccaggtcctgacagttatggaatctttcaaggacacatttgaccagatgagatttggcaggcgtttgtgtagagcctcacagtccagacagtgcctcaccgtattatgatgtgggggtgggggcgggcttctggtgctcttgtcctccacacaggcctgaaacagcacaggactggggaggtaccattggaagcacccgcaaccctaaaggcactgaccctaacctcacgtctccccactagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtaatggctgggagtgagcagcagtgctgccacgtggccttggccttggtggcggcttcctctgggtgtgtggaagaggtgggcagggacttcagcagcatggagagccatatcaggtgggctgtctggttgggggagggcactacgtggagtgtttgccatccttctgccttaaatgtctcatttgaaatgttagaaccaaccaggtgcggtagctcacatctgtaatctcagcactttgggaggccgaggcgggcggatcacctgaggtcaggagttcaagactagcctggccaacatgggaaaccctgtctctactaaaagtacaaacattagtcaggcgtggtggtggtctgagtagtcccagatacttgggaggctgagacaggagaattgcttgaactgggaagcggaggttgcagtgagccgagatcacaccactgcacttcagccagggtgacagagtgagactctgtcaaaaaaaaatattagcatgtccactgagaggacaagtgggggtttaggacagggaccctttcccacagcagacctggtttccagcataaaggtctgatggggtggccagggaacaggaaggacctcctccctcatgcccatatcccggtggaatctttcatttttttctgcttcacctaaaaccttgaccttgatttgacctcgggccacatctccaaccttctctaagaatccaagctggaagtccagcttggaatccgagggagcatccgtgtacacagcctacttcaccatccccgaggtgccctccaaactgccccatgaaggaagattctagaaataacattgagcaccttctctatgccaagagctgtttgagctagacatgtgaagatgtcattcacccctagaccctgcaaggtagccaccgtcaagtccacttgacacatgaggaaactgaagcccaaggggtgaggtagttagcccacgatgacagggccagcagatggcaaacccggggtggagcctggcctccccgtagagaaggtgtttaacctcgtggcgcgccttccctggatgggctctgctttgggacagctgggcggatcttcctcccttccacccttacgggcagcttccctccctgtcctcgtcccaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccggtgagtgctggcagcgcagggtgtagggggtggctctccatgggtctggctctgaccctcggctgtctctgcagcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggtaaaaatggggacagggcatgggggtgcattcctggaatcccagcactttgggaggctgaggtgggaggatcacttgagcctaggaggtccaggctgcagtgagccttgatggccccactatactccagcctgggtgacagagcaagaccctgtttctttgttttttgtttttttagttttttggttttttggttttttggttttttttgagaccgagtttcactcttgttgcccaggctggagtgcaatggcgcgatcttggctcactgcaacccccacctcccggattcaagcgagtctcctgcctcaacctcccaagtggctaggattacaggcatgtgccaccatgcccagctagttttgtatttttagtagagatggggtttctccatgttggtcaggctggtctcgaactcctgacctcaggtgatccgcctgcctcggcttcccaaagtgctgggattacaggcatgagccactgcacccggtcaaccctgtttcaaaacaaaaaaaacaaaccgggtggcaagcagtgggtgagggttcctgctgggtgcagcctaggaaccccaagaaaaggagggtcctgctcaagtgctggtgctgggctcctcatgaaggcaggacacctcattcagtgctgaggtcaagagggaacctaggagttcacgcaaatccagggaaggcgtgggctcacctcctggggtcaggactcagggatccagtagcaggacactaccccaactaagctcccagtgagcgtgcagccaaatgcgtaactgtcgggctgttaaaagatgcatgggacacagctggcgggagtgggcagtgcaagggggcggtgagaactcaagttcagaaactgactgccctggcctgcgcccccgccctgctgtttgcagcctgtggacctggggaagggacagggtgctttcctcagtttccccatctgtaacatgaggaagacagcattttctccttcacaaggccattgaaaagatgcaatgagtgttagaacagtgcctctattggtcagagctcaatagcagctattaggattgggtgagataagtcatgtacagaaacagtgttcatgactgggtactgtggctcacacctgtgatcccagcactttgggaggctgtggcaggaggattgcttgaggccaggagtttgagaccaggctgggcaacataacaagactctgtttcaaaaaaaaaaaatttataaactagctgggcatggtggtacatgtctatagacccaactacttggaaggctgaggtgggaaaattgcctgagcccaggaatttgaggctgcagcaagctatgattgtgccaccacactccagcctggacaacagagacccacagagaccctgtctcggaggaagggaggaagggaggaagggaggaagggaggaagggaggaagggagggagggagggagggagggagggagggaggaagggaggaagggagggagggagggtcaggcgtggtggctcatgcctgtaatcacagcactttgggagactgaggcaggcagatcacttgaggtcaggagtttgagaccagcctggccaacatggtgaatccctgtctctactaaaaatacaaaaattagccaggcctggttgtgggcacctgtagtcccagcttgtagtcccagctactcaagaggctgaggcaggagaatctcttgaatccgggaggcggaggttgcagtgaacccagatcgagccactgcactccagcctgggcgacggagcaagactgtctccaaaaagaatattcaatactcccaagcatgtccctcacctcttagctgagagcagccagtgccctgatggcggcagacagctgccgacatattcccagggctgccgacatattcccaggcactacaacatcatagttaagagcacaggccccagaagcagctgcctggttcagctttctggcttgtcacatgttatatggcaagtcttgggccagccacttgacttccctggacctctacttcctcatctgtaaaatgggggtggtgatcattgccatctcatagggtggctgagtgggattaaaggagaacgtgtgttaagtttttaggaccttaccaggcatacattagcattctctattgcgagagaccctgcccggccacacaggatgggtgttgaagttcttctcggagagagttgctggctgggcgtgatcacacatgtagtcccagcactttgggaggctgaggttggggggttgcctgagcccaggagttcaagaccagcctgggcaacatggcaagaccttgtctcttctaaagagagattcctgggtgaaagcagcttccccattctgggcctgtttgttcacaggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagtaagtgaggctgggagctcggctgcctataatgcccatggcaggccactgctgggaactggataacctggcatcccttgtggactgcctgctgccatccctaccctcaaagatctattccctacccaacagatcaggtgacccacttaaaatgtgaatcaggctgggcgcggtggctcatgcccgtaatcccagcactgtgagaggctgaggcaggaagatcacttgaagccaggagtttgaggctgcagtgagccatgattgcgccactgcactccagcctgggcaacaggcctgggagactgaccctgtctcaaaagaaaaaaaaaaaaaaaagcacgtatcagatgtggctcctgcagcctcccatcttgcatgtgataaaacctaaactccttcctgcagctccagccggcctcccccgatttgccttctagcctcccccttccatgctcctcgtccctggaacatgttccagctgacatgttccagccccactggcttcctctgctccttcaatgcacagcttggacccacctgaaggccttttgcaatggctattcctgctgcccagaaagcttccccccgcccctgagctcccttccaggcaggcttctccttctggcttcagcccaaagatcccctccttggggaacacttttctttctctcacagctgaatagcaccctctttgcctggtctctcccacacttgtcactgtctgaaatcctccttgtatacttgttcttttcccactcaagtggcgtgaaagtagggggccgcagtcacgcctgcatttgtccggcctagaatgacactggcttgtggcgcgtataccattctgggttgagttgcgtattgggtgccttctaggggctggggtctgtcctgggcaccggtttggttggtggccgctgcccttggcgctcctgttcctgctctggccccatgccagcctctcacctgcgctccgtctcctccaggcatgaggctcagagactggagcaggaagcccgcggccggcttgagcggcagaagatcctggaccagtcagaagccgagaaagctcgcaaggaacttttggagctggaggctctgaggtgggttgagaactagaggaggagactggcaggggccgagggtcttaggacagcagctggtgtgggcagcaggcctgggtggggtgtcgatgagacagtgcacggctacagcataagccaaggccgtggggggactgggctgtctcccgggtcttacctgactctgccttctccccagcatggccgtggagagcaccgggactgccaaggcggaggccgagtcccgtgcggaggcagcccggattgagggagaagggtccgtgctgcaggccaagctaaaagcacaggccttggccattgaaacggtgagtggggggaggcattaagaagagggtggccttgagtcctggaaaaggcccattccctacagtccctgagactgtataggacaccaggtcccccaacataaagccctatccaagtactttgcatttgcaaagtcctttgccttgtaggattcattgactccattgctggaaggtaaggattagaacacccattttgcagctgggcgctcatgcactggccaccttggcacaagtgctgtgtatgcttcataggcattatcttatttaatgcttgaaatcccattaagaggccgggtgcagtggctcacgcctgtaatcctagcactttgggaggccgaggcgggtggatcacctgaggtcaggagttcaagaccagcttggccaacatggtgaaaccccatctctactgaaaatacaaaaaattagctgggtatggtggcatgtgtctgtaaccccaactacttggtaggctgaggcaggagaattgcttgaacccaggaggtgtggaggctgcggtgagctgaggttgtgccactacactccagcctgggcaacaagagtgaaactccatctcaaaaataaagtaaataaaaataaatgtaaaaagaggcctagtgtggtgcctcaggtctctaaccccagcactttggaaagctgagatgggaggatcatttgaggtcagttcgagaccagttcaagactagcctgggcaacatagcaagacctcatctctacaaaaacaaaattttttaattgactgggtgtggtggcacatgcctgtagtcccagctacccaggaggctgaggcaggaggatcctttgagccaggagttcaaggctgcagtgagtcctgatctgcattccagcctgggtcaaaaaataaagaatgattgatttttcctcttccaggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtgagagttggggaaggtgtgttggtttcaggaccaaccttgaaaccaggaaggcagagccaaggcggaaaacacaacatctggaaagattgtggggaagggaggggtgagtgacctgacccacgatgcagggacattcacacagtgtcacgctgcatcaacgtcaggcactgtactagacccagcagtgagccagagctccggaggagacaggaaatggatgggacgccagtctgacaggcatttccaaggcagtcaagcagggtggtcagatgcaggggaggtgacccttcaaaccagctgacttaaggagggtcactctgaagtggccagggtttgacgcccatctcaacttcctcctgttctcaccctccaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctgggc

SEQ ID NO: 65 - DNA, 4901 bp, Homo sapiens
tcattgacagacgagtatttattaagcagctactatatgccaggttcaagttggtcttactctagggatagagaagagaacaagaaaagtctgtgccttcatggagtttacattctagtgagggtagaaaatatcaagaatataaatacatgtagacagtcagtgacatcaaacaagtgggcggtggggacaccacatgagcatgggtggcaggagggcctctctgtgaggtcactgtgggtagacggagaagccagccagcaaactggaggaaaagcacccagacggacgtccttccctaagctccctcaacccaggccctgagccaagaatatctgaaaggaaaccaagtcaaatagtgaagtcccgccaggaccagggtaggcaggacagaggagccggtgacagggaaggctgtggatggcttcttccctcctgggcatggtgccccaagcttgctctggctgggggcggaggtctgactcccgcctttcaggaaacctggccctcacaccacctccctcactcaagcgtccctagcatctcggaccccaggactgagcaggcagggtgtgacactgcccggtcccggcaccccaggagcaccgcctggatggagggggcctcccgcgtatcctccctgatttgaggcccgggtcctcaggatcccagagaacgtgacgtcaccaaagagaggctgacccccatcccagcaggtagaacaacacatgaggaaggcgtgagactgggacctcctagcagggggtggggagctgtgtggcacagcaagactcccagggcaggtgggcagccaggacccggggctccagcgtcacttcttcttggcgcggtctgctgcgtccagggcagccatgttgcgggcggccgtgatcaggtggatgacgctgatgagcgacttcagcaaggcgatgggggcagtgacccagaggcccatccggaacagtcccacagagccaactgcaggaaggcagcaggggagtttggggcccgaaggagggggcctccatctccctgggcaggccagatccccctcccatcctcctgcccagcccctcatctcctacctaaaggtccctcagagaaatggaacaggtagaggaggcagtagaagagctcattcccagcacacaaggtgaacagagcaggctgcacacacagcaaacaggccacgttagcaagaggcaggcgtgtgccaccccctgcccccccagcactaatgaaggcacaatctcggcatattacttctcttatttttttttcttttttacagacagggtctcgctctctcatccaggttggaatgcagtagtatgatcatagcactgcagcctcaaaactcctggtctcagccaggcgtgtggctcatgcctggagtcccagcactttgggaggctgagacaggcggatcacctgaggtcaggagtttgggaccagcctggccaacgtggcgaaacccctctctactaacaatacaaaaattagccgagtgtggtggcacgtgccggtagtcccagccactcaggaggctgaggcacaagaatcgcttgaacccagcaggcagaggttgcagtgagccgataacccgccactgaactccagcctgggtgacagagcaggactctgtctcaaaaaaataaataaataaataaataaacccttggtctcacgcaatccttccaccttagcctcctaagtagagactacaggcgtgtaccactgtgcctggctaagctaattcaagattttgtgtgtgtgtggaaacagagtctcactttgttgcccaggctggtctcaaactcctggcctcaagcaatcctcccacctcagcctcccaaagcgctgggattacaggcatgagccaccatgcccagccattatctttttaaaaatccttccagaggctgcctgtgttcctggaatcaagtccacactccagccctgcagacctctctggcttatctcccttcccgctttcagtcccttctctttgcaggcctcattcccacttgttccctggagtaattcacacaggccttccccaccaatcctcctcctccacgcctcagcttacgggccctcctcctggagtgactgggcaggccctgctctgcgccctcgccttctcctaggctaggaccaggattcagcccagggcttcccacagccaagagcctgaggggtggggtgtgcaggaaatgcttaccctcgaggtgtagtagatccgaagcaccggattcccggacaagtcgatcatcttgtgactctcactgcctcggaccacagaacttggggagaaaacaggggaacccacaaggtttcatgaccactaccatgcatccaatcctcatgttaacacctattgtacagatggaaaactgggcacggctaaggaccagtatcctgccgaaagccacagttacctatttgggggcagagtcaggattcaaatgccacatttgaaagctcccatgccccttcctataagctgtcacctatatggaatcctagaatacccagccagaagagtcctaagaattgcttaatgcaactgtaaacatgactgaagctttaaagagaggcaggtttgcctggggtctttctacaaagcagagctaaaaaggagcccttccaggatgcctagtgccatcccagacacccttccgtctaggctcagcccaccccactgtaatgtctccaagtggcccaggcccccagaatcgcagcagacctgtggaggtgcagccagtgactggccacatccaaactcatgctgatttggaagaacagcgtggctccagggtacagcagggccaggttgaccaacaggcacatggtggagcagcggtccgtcagcatgtccagcatggccccaaaccgggttcctggaagattaggtgggcaagggctgttatggcacagtggatgcaggacaggtgcccatatttggtttatcactctgacgcagggtgtaaacgaagactggaagtgtccgcctgcctggggaggaacgcaggctagaaaacaggctgtgtgtgaggtcagtgggcaaaggtcaccatggcatgaactgagaaaggcatgagagtggagggaacagggtaggaggagaggaaagctatgtctgcaactcatcaaccccagaaccaagactccagggctagatagagacttgatgcctcaggggaagccttacagttgggtctggagaacagattaaaaaattagtcaaccctccagaagccatcacccttccctctccatcctccctctaagcatgccttctggaaccccaactgcttatgcagggcacacagtaggcctccagtaaacacctgttgaatacactgttttttgttttttgtttttttttttccgagacagagtcttgctctgtcgcccaggctggagtgcaatggcgcaatcttggctcactgcaacctccgcctcccgggttcaagcaattctcctgccttagcctcccgagtagctgggattacaggcacgcgtcaccaagcccgctaatttttgtatttttagtagagacagggtttcaccatgttggccaggctggtctcgaactcctgaactcgtgatccacccacctcggcctcccaaagtgctgggattacaggcgtgagccaccgcccctggcctgaatggacttgtattcagagagacctccagcagcgccaccgccatgtcatgtcttgctaatccacacctctcacaagcagtgagttctcaagagctagcttaaattccttttgctacaaaatcagtccattcttgctgggcgcggcactttgggagcaaggcaggaggatcgcttgaggctaggagctggggaccaatctgggcgacactgcaagacccagtctctacaaaaatttaaaaattagccgggtgtggtggcacgctcctgtagtcccagctagtcaggaggctgaggtgggaggattacttgagcccagaagatgggggctgcagtgagccatgatcgcgccactgcactccagcctaagtgacagagcgagaccctgtctcaaaaacaaaaaaacaaaacacaaaacaaaaagccccaggccatcctgttctgctttttccagagatgggaatgacagccctctgactctgaggtcccgaggaggcaggggaagggaggaggggattgttgaaccccaaggctggctgagaggggtgtctgtcaccttgattaagagcgcgagcagcgtgtccatcgaaagcgtccagcaggccgctgagcaggtagaaggaggaggccgtgagggggcagcagggcatgaagtagaaagaaatgatggcgaagacaatccgggcataaccttggaacgggacgcggggagacagggcaggatcagggagcccgccaaggcccctcgccctctcgttcggcccggggccgtgggcagcactcaccgatgaggttgggcacgaacaggaagatattttcgtctggcatcgcggcgcctcccttgctgccccgggcctgctctggagatgccagtgctgtcccagccccgcagcgcggcctcagcctccggcccggcgcatcggccgcaccacctgcgccctggaccccgccgccccaacctggccccagatgctgaagcccgcagccgtcgggagcatggaccggccccgaggtgcgcgggacgcagggggcgcgcgcagtccgcccttcctacccgcaacctccctcgcctctgccagccccgcaggcgctccgggcctccagctgcggtcgccgctgctccagctgcgcgtggcttccgggaacctcctcctccgcgcccgtcgttgcaaaattggagagaggaaaaagtggcttaaaaaaatagttgcggcccctttaaggcctg

SEQ ID NO: 66 - DNA, 27746 bp, Homo sapiens
tttgggcggcaggatgctggtttatttactgtaggatctccagggccatcaaagccccctcgtgggatagggagactatttacacagccagggaggagggcagccaggaggcagagaccgggtcccgtatttccctctgcccgaatgaggaggggaggggcgtcctgggtcctgcagctgtagtcttggggttcagatggaaacttcatactcccgcgtatcctgaagacagagagatcaggtcagttgttggagtctgataggggtggaagaggcagccgaatgggaggaggggcaacgatcctgggttttaaagtaacattgacctctaggggctggggggccagtgaatgtgtttggttcatcctacggtgtcgtaaaatgacacaaaaatctgaatttctggcttgtcttgaataattggaagatctgccaattgtgcctcagtttcgactatggggtagagccgtattcttgagatggggcacaagtcctccacttagccacagtcctcaccactccctattgtatacacatggcttgctatgctcattgacatggcctctgggggcagctgagtttgaaattcccaagacagagattccagagaccttgcgagaaggttatggagtcctgggagagccaagtggtggctcttcaggggcaggcaaggtgcttaccccagcttcatacagcgggttgctgaagtccgactccacggtgatggggctgtaggagtgggagcccgagaagccgaaaagggactttccctgaagcctgggaaagggagaggacagaggagcttatcaacaggtaagcccctgagctcccctgacccaggctccagtgccaggctcgcaagacgtctgccctggccggcagtccccaagcaggctacttacttggtgtagtagatgtaaacgccactgccgaggacaatgaccaagcctagaggcagcaggatggccagggccaggttccccccttccagctgccgtgatggatctgtggtctgggtcactacaggaggaggagaggccggtgagctgtggctgggcccggtcctgggctctcccagcctcctgccctgggcctcaaaccctgggcttcatccctccaaggcctggcctcctgccccagcctctgccttgccctcccaacctggccagcctgggtctccacctgtgctctcactgaccttccagttttcggttgtccaggagctcctcataggcaactgcagggagaggagggggaggggatggggtctgagccagggaggggaggaggctgggaggggccgggagcccggtggggctgggctggacagcctggttctctctgccctctgctcaacctcaactttctccctttgtggggaagagagaggagtgaccagcacagggcctttgtcctctttctccagacccctaaaaagtcagggttcctggacagtctgagccaaactagaacttgtcagcgatagggaaactgaggcctattcagagcaagggacttccaagccaaggccccctctactacacccctgagccaatcccatgacctcacacgacccagggcttctggacacacccgtgaggacacgaggccacaggaggagaaccgggagctctgtggggtcgcccattggtctcaaatgtgctacctgactctcccagccctgtcacttcccggacactggtgtgcccctcctgccctgtctggccaggcacctttgcagagtgggggctggctggtccactgggaggggtggccgggcacacaggtgatggtgacctcgccgataagctcaaagccctcatagcagaagaagcgcagagactcgcccgcctggtagtggtgcttgtacagcgtctggtagccattctcgggaacccccgggttcaggcacggctcgtacttcactgcggggagcatgccagtcacgtgccagctgcactactgtgcacggggcagacgggctctcccagggctacccagccaccctcccagggtgtgccccagactcacaggcgcatttggggaccctatcgctccacttgggtgtgcctgtgtcccggctgtagcaggtgagcatggctgccccctcgaggctgtaccctggcaggcagcggtactggacgtgggagccaacggggaagccggcgtccgaggcggtgcggtgcccgttggcaatctcgccagggtcagcacaagtcatgactggtggcagaagaacaaggtcagggggagcgagggccttcaaagatcagcctgggcaacacagagagaccccatctctacaaaaaattgaaaaattagccaggagtggtggcgcactcctgtggttccagctactcaggagttggaggcgggatgatcgctcgaacccagcaggtcgaggctgcagtgaatggtgaccacgctactgcactccagcctgggtgacagagtgagacccagtctaaaaaaaataaaagaaaatctcccagaagcttagggctgggagaggcctgagcctcaggctgtttcctctgaacacctctgcacacacacgcacttcccaccaattcctcagaaggaagagagcatgaattggaaaaacttaaaatgcagtgcatctattttcaggccagaatgacaggcttaatttttttcaaaattcaacgtatgttatatttcaggcttcgtttagtaaacagtttgcttggggaaaccccaagcccctatcctggggtgaaattcaaaatatttaaccaccataccagagcatactagccaaatcccagcagggtgagcccaacatggcttgtagtctgtggaacagcagctgccctctttagagggggcccagctctcctgtccccagtattctcattatgcccagcccagttcactcacatacactccctgccttcaggcgtttgagtttacaaccctgttgtgaaggaatcataatcatagccatttcttgtatataagcctgagctacgtaccctgctaaatgttttacaaacaaatataattctttgtgtgtgtgcttgttttttttttttttttttttttttttttttttttttttgagatgggagtctcgctctgtcgcccaggctggagtgcagtggcgcatctcggctcactgcaacctctgccttctggactcaagagattctcctgcctcagcctcccgagtagctgcgattacaggcattcgctaccatgcccagctaatttttgtatttttagtatagacagggtttcgccatgttggccaggctggtctcgaactcctgacctcaggtgatccacccacctcagcctccaccagtgctgggattacaggtgtgagccaccacggctggccccaaatataattctttgttttggagacgagaacttgctctgtcactcaagctggaatgcagtggtgagatcacggctcactgcagcctcaaactcctgggcttaagcaattctcgcaccacagccttctgagtagctgggactacaggcatataccaccatgcctggctatattttttattatttgtagagacagggtctcactatgttgcccaggctgttctcaatctcctgggctcaagtgatcctcccaccttggccttccaaagcactgcaatttcagatgtgagccaccacacctggcacaaacataatatttaatcctgattatcctgagaggccaatgtcactgtcatctcccttggagcccagggctcagggcggtcaaaggacttggcccatggtcattcagccagggagtggcagagccggaatctgcccagggtcacagccatggagcactggacagggactcagatatgtgggtcctggcacaccttcaggctcaatctgctgccttgggcaggttccctcctgagcccgaggcagcggggccagccgaactctcagccccatccaggcctgatatcctgtgaatccttccaggggcgggaagctttgtccagcccaaatctggctacctgaagcttctccccttggtcccaccattgcttccagatgccacatggaactacagccccatgtccttggggctggcttcctaaaatttggagaaagtaaccagctgccattcctttctgctcttcaattttctttttctttctttctttctttcttttttttttttttgagatggagtatcactcccgtggcgcaggatggaatgcaatggcacaatctcagcttactgcaacctccacctcccaggttcaagcgattctccttcctcagcctcctgagtatctgggattacaggcgtatgccaccatgcccagatagttttttatttttagtagagacggggtttcaccatgttggccaggctggtctcgaactccagacctcaggtgatccaccgcacctggccctttctgctcttctaaaagatacacactcccagctcctttaaatgtcacctcctctgtgaaatctcctgccccagccctgagaaaattagcccactgctctccccacagcacttcgccacgcccagggcagcatgcgccctgtgaactttccatctgctcttcacaacctcagtcctacttcgccgatggggaaaccaagcctcagaaatgctaagtgcctcgcccaaagtcacccagtgatcaccaccctgcgtatccctcccagactgcgagctccataagagtatggaggggcttgaacccccttcgcctaaccccaacccagcacggggcttcaatgatggcattcaaataaaccaagtgctctgacaagccttggtcctagcaaagtggctccctacaatttcaactgataggactgcgggattggggcggggcgtaggacaggaaggtggagccaagtgtggacccggggagcccagtgggaacctggtcggagcccttttaggggccaaactcagatgccgcagaggaggggtcaggaggggacggggcggggccgtgagacgaggaaacagggaccgagcccaggtcggtgcaagaaagagggatgcagcccggagaagatgagagggagacccagaggggacagtttcggggaaccgggcggaggagtgagaactaaagggcatgggggcaggccttgaagaagatccaggaaggaccccgagcgaagggatggaacccagaaagcacgggggtcgggacaggacaggccgacgacggggcccacagggaaggggcggggccgaggggacgcgggcggggccggctcactcttttggcaggcgggcggcgcggcgctccaagacaggtcccactggcaagtgagaatgtcggagcctagcagctcgtagccaggctcgcactggtaggtgagcaccgtgccccggatcaggtccccgtgggatgccgttctccagccccactccggaggtggcagctcggggcacgtgtcgttcctcgggacctctgcaggggagggaaggcgagtttggaggctgcgttttaactgcgggctcccttccagcctcggaggctttgctctgtgccccctcccgggatctgtctctctctctctctcttagagacagggtttcctgtcgcccaggctggagtacagtggtacaagcatagctcactgcagcctcaacctcctggcttcaaacgatcctcccgcctcggcctcccaaggccccgggataacaggcgtgagccaccacgaccggccacctcccgggatctctggcctgcccgacccctgcccatcccgggactctatccctcagtacctttgaagtgcaatacgaagccctggcccaggcctggatttgggggcccgggcggtgcctgaaactgcagtgtgaggtcgggcccagaggagagaaggcggcggcgcggctgaggtccccgcagctgggccaagactcgggcgctgggaccgtccccgtcgaacagcgtcagcatgtccccttcccgcacattcaatctgcagggggtgagaccaggcaatggggcggggctgcgactggcccctcccatccagctctgccccatcctcaactctgctcattggtagcccctcctactctccagccccgcccatattctcctatcccaggtctggcgccgcctccgttttgaccaaccatggtttctcctatgctagtgcctcagggttcccctattctatggctcctcccatgtcctactacccaatccctaagcttgcacattactaactccgcccactgtccactccctcctccatcaccatgagatccacagcctagcccaactccagctctggccaatcacagaccaaattcgctaacgccctacacaactctaggccccgcctgagtacctgctttgaagccacgcccacttcagcttctgtgccatctcatgacactctcataccaattcagctcactggattctccccagacctccccaacttgctggtgttaacgcaacagtttgggtctgtgtccgtggaaatagctccaggggaagcctcagaaacctccaaagagtgagaggcaccaggccagagccccttgttcacagtggcccctaaggaaggctgcattgccctatttatttgtccgaggttgcctggctaatatgtgatttgagcccagctctctcacgtctatcctgtacccttagtgcaccagcctatccaccgaattctggatagatacgcaagagccagacaggctcagaatgcaggctactgcattggcataccacactttgctgagcctacacccgtcgcaccctctgcaggacccaaacatacatctcaacttggagcaagatgcgcttctcttcctggacgtgcacgccccacacgcagtcttggcccgggctatagctctggggccagtcgggagagaggaccacgccagctggttccgacagctcccctccacacatggctagggaaaaaggggtgtcaggttcaggacccaggtgggcatgctgtcttcatttctccacagtcctcaccactcgtgatgcgtgcaccacatcacctcgcttgtttcctattacctatgatccacctgtttcttttattcttttattttatttatttatttatttttaaattttttttgagacggagtctctctgtcgcccaggctggagtgcagtggtgcgatcttggttcactgcaagctctgcctccctggttcacgccattctcctgcctcagcctcccgagtagctgggactacaggcgccgccaccacaccctatttttttttcttttttctttttttttttttttgtatttttagtagagacggggttttacggtgttagccagaatggtctcgatctcctgacctcgtgatctgcccgccttggcctcccaaagtgctgggattacaggcgtgagccaccaggtccagcccctatttttatttttttagacagagtctcactctgtcgcccaggctggagtgcagtggcgcaatcccggctcactgcaatctccacctcgcagactcaagcgattctcgtgcctcagcctcccaagtagctgggattacaggcacgcactaccatgcccggctaatttttgtatttttagtagagacggggtttcactctattgaccaggctggtctccaactcctgacctcaggtgatccgcctgcctgagcctcccagagtgttgggattacaggcgtgagacactgctcccggctttatccacctgtttcttttttctttctttctttcttttttgagacggagtttcacacttcttgcccaggctggagtgcagtgctgcgatctcggctcaccgcaacctccgcctcccgggttcaagcgattctcctgcctcagcctcctgagtagctgggattacaggcatgcatcaccatgcccagctaattttgtattttaagtagagacagggtttctccatgttgatcaggctggtctcgaactcccgacctcaggtgatccgcccgcctcagcctcccatagtgctggtattacaggcgtgagccaccgtgcccagccatgatctacctgtttcttgccgcatctaggtcctgttgtgttcaatatccagtcctgctcttaacaaaccctgcccactctccagcctgcccaatctgtgacttaacccaacagcagttctcgctcttgaagacatttgggtttgtgacccctgcattcagtaacaagcccagcagttattcagctaagaaaacagcctctgaagggacagggatttacccaaggcttgggtggatgaagtctggatgtgcagccttcctttctgaacggccttgctgggatccccagttcagggggcaacgtggactgaaggacatgcctgcgacaaggaaggctcacctttgcaggccggctctgtgtcgttccagtggggttctgtgggatccacacattcgatggcattggggggcccagggggctccagggcatatcctgggaggcacgagaaggttgccagtgcccctgggcgatactcagggtccgtggtagtgacatttccatgtgccaggaagggggcgaagcagcgatcctcctcaaaggctgggaaggagtcagtcataacaattaagcattaggacaggcctcaagggatcttaaattggggatgtgggctgaattggggtgttctttggccactcactgggcttttttttttttttaaacagtcttgtgctgtcgcccaggctggagtgcagtggtacaaccttggctcactgcagcctctgacttccaggttcaagcaattctcatgcctcagcctcccaggtagctgggattgcaggcgtgcaccaccatgcccagctattttttttttttttgagatggaatttcacacttgttgcccaggctggagtgcaatggcacaatcttggctcaccgcaacctccgcctcctgggttcaagcgattctcctgcctcctgagtagctgggattataggcatgtgctactacgcctggctaattttttgtatttttagtagagacggggtttctccaggttgatcaggctggtctcaaactcccgacctcaggtgatctgcctgcctcggcctcccaaagtgctgggattacaggcatgagccaccgtgcctggccaatttttgtattcttagtagagacaggggtttcaccatgtcggctaggctggtcttgaactcctggcctcgagtgatctgcctgcctcagcctcccaaaatgctgggattacagacatgagtcactgcgcccagcctgggtttttttttaatttttttagagacagggtctcactctgttgcccaggctggagtgcagtggtgtgatcacagctcattgcagcctagatcttctaggctcaagtgatcctcccacctcagcctctctggtagctgggactacaagcatgcacaccccacccagcagctcattttctgattttttttttttttctgtagagatggagtttcaccatgttacttaggctggtctcgaactcctgacctcaggtgatccgctggcctcggcctcccaaagtgctgggattacaggtatgagccattgccctggcgttggtgggtttttaaaaactgaatgccactgggtttagcattcactctccagactgtcaaaaaaagttctaacactcctcattcacatatttatattgcctccctggcctctggagggaagccactgagctagccaaatcccagccaccattctacagagcggaggtccatagaccaaaaagccacttgctcaaggtcacacaaaagacaatggcaaaagcaggtctcaaacccagatggtttgattcccagccacagatacttggctctggaaacagcagagatagcgggtaaggggaggggtgccttcagagaactggctggtgtaggtgtattgtctcctcagaaataacagttggattctgatcatccatgctgttgctgaaacccaaaatttcagctaatgcaaaaactactcagtttttacttcaagtcagcaaaagtgaacatttgtagagcatttgagtttctgcccacctgatcggatcttagctgcaaaactccctgtaagttaagatttaggtgcctatgataccaatgaggaattcttttttttttttttttttttttttgggatggagtttcgctcttgttgcccaggctggagtgcaatggtgtgatctcggctcactgcaacctctgcctcccaggttcaagtgattctcctgcctcagcctcccgagtagctgggattacaggcacccacaaccacccccggctaatttttgtatttttttagtagagatggggttttaccatgttggccaggctggtctcgaacacctgacctcaggtgatccacccgcctcagcctcccaaagtgctgggattataggcgtgagccaccatacccggccttttttttttttttttgagatttttaattttattttaatattttatttttttattttttgagactgagtctcgctctgtcgcccaggctggagtgcagtggcatgatctcacttcactgcaaactcggcttcccaggttcaagccattctcatgtctcagcctcctgagtagctgggattacaggcacgtactaccacacctggctaatttctgtgtttttagtagaaatggggctttgccatgttgcctaggctggtttcaaactcctgggctcaagtgatccacctgcctcagcctcccaaaatgcggagattacaggcatgagccactgtgcccgggttattttatttatttttaaaaatgaggccagatgcagtggctcacacctgtaatccccccactttgggaggctgaggcaggtgaatcacctgaggtcaggagtttgagaccagcctgaccaccatggtgaaactccgtctctactaaaaacacaaaaattagctgggcgtggtggtacatgcctgtaatcccagctactcagaaggctgaggcaggagaaccacttgaacccggaaggcggaggttgcagtgagccgagattgcgccattgcactccagcctgggtgacaagagcgaaactccatctcaaaaaaaaaaaaaaaaggaaaaaaatgagacagggccttgctctgtcacctaggctggagcgtgcaatggtgggatcacaactcacagcagccttgacctcctgagctcaagcgatcctcctgcctcagcctcccaagcagctgggaccacaagtgtgcaccaccacacctggctaattttttgttttgttttgttttgtagagacaaaggtcttgctatgttgcccaggctggtctccaactcccaggctcaagtgatcctcccatcttaacctcccaaagtgctgggattacaggcgttagccattgtgcctggccacagtgaagaatcttaaactcatagaatagcagtggcctacaactctggagtcaggactcacaacttgctattttcggtaaaagatctgtgctgtttgcactttaacactcccagaatctatcccgcaattcatttttgcagatccactgttctatttcactgttacttaacctgcaaggtatcatgtccaaatcctacccatccatcacagccgagtgccaattccatttctcccatgattcatatcaaacactagaccctcctatctctaagcatttcatctttttggtctctctcttgctactgtttatacaactcctctgtttcagccacaatgaaattctgtttcccagacataccaggcatttccctacttgctgtttctcaaagttcctctctttccttttcttttcttttcttctttttttttgacagggtcttgctctgttgcccaggctggagcacagtggtgcaatcatagctcactgcaacctctggggttcaagtggggttcaagtgatcctcccacctcaaccttccatgtagctgggactagaggtgtgtgccaccacacctggataattattacttttttttaatttgtagacacaggatctcactatgttgctcagactggttctcaaactcctggcctcaaacaatcatcccaccttggcctcccaaagtactgggattagagacacgagtcaccacaactggcctcaatcttcctcttttaaaatatcctctgttggctgggcagggtggctcacgcctgtaatcctagcactttgagaggccgaggtgggaggatcacttcagctcagtagttggagaccagcctgggcaacatagtgagatgctgtctctacaaaaaatgtaaaaattacccaggcatggtgccgaacgcttgtggtcccagctactagggaggctgaggcaggaggatcacttgagcccaggaggttgaggttgcagtgaaccatgatcgggccaccgcactacggcctgggcgacaaagcaagacctatttcaataataataataataataataaaataccctctatcctttaaggccaaggtgaaatgcctcttcctccatgatcacttccttgtttctaccccttcacattcattcctcttcttctggtaacggcatcccaattttaattttgggacgcaggccttccccactcccagtccactaggttaagttggagcccaccagggaaggccacgtgaggcagattagccaatcccaatactcccttctcctagctcagtgattggctcaggctaaggccaaccaggatcttagtcaggtcaatgaacgcctctcctggcatttttgctgagctctcaggaaatatatgagtgttctctctgatgaggttactcggttggtggtatgggctggaggaggtggcttacacctgtaatcctggcactttgggagtcccacatgggcgaatcacttgagcccaggagttcaagaccagcctgggcaacatggtgaaaccccgtctctactaaaaacccaaaaattagctgggcgtggtgatgcatgcctgtaatcccagctactcgggaggctaaggaatgagaatcgcttgaacctggaggaggggggctgcagtgagctgagatcgcgccactgcactccagcctgggcgacagagaggaactctgtctcaaaataaataaataaataaaaataaataaaaactaaaaactgtcaggcgcagtggctcacgcctgtaatcccaacactttgggaggcggaggcgggcagatcacctgagttcgggagttccagaccagcctgaccaacgtggagaaaccccatttttactaaaaatacaaaattagctgggcatggtggcgcatgcctgtaatcccagctactcgggaggctgaggcaggaaaatcgcttgaacccgggaggcagaggttgcggtgagccgagatcatgacattgcaccccagcctgggcaacaagagcaaaactccgtctcaaaataaataaaggccgggcgcggtggctcactcctgtaatcccagcactttgggcggccgaggcaggcggatcacaaggtcaggagatcgagtccatcttggctaacacggtgaaaccccgtctctactaaaaatacaaaaaaattagtcgggcgcggtggcgggtgcctgtagccccagctactcgggaggctgaggcaggagaatggcgtgaacccggaaggcggagcttgcagtgagccaagatggcgccactgcattccagcctgggtgacagagcgagactcgtctcaaaaaataaataaataaataaataaaataaaaattaagttggtggtatgtaagtcggcagctatgtccatcacacagggaaagtgcctaaggatgaagccagcacagaggaaagaaccgagatactgagataactggtctctgggctatgtacctggatccagacattcatgaagcttaaacagagaaggctgcctgggggaaggagaaggggtccctagaagagatccttgcagttttggggcagggaagcgagtcacgtttcaaggaacccagcacggagatgaacaggcatagagtttgtgcttccgactatgcttggtgtcaggaagaggggaaggtgtggcggttggggtcctgtgggggagtgggtcacttaccttcaaatcgaaggcttaacagcaggggattggcaggtgtctctgacagcagctccacgtagagggactgggcgtcactgatgagaccccgctcggggacatcgtccatgtccgaatcatagatcacgggggatagggggctgccccctgagcgcaccatcagcctgggatggacagaaacgtgaccaggagctcaatctccctcacaagctgcctcaccccttgcctgctttcctaacttatttttatagctgttatcatcacacataactatatgccacgcactcttctaagcccttacacattctatctcatttaattttcacaagaactcttgagtcagacactattattatcctttattttatagatgaggatattagggcatagaaagatcaagtaacctgtccaaggtcacagagcaagtagtggcagggctgagataccaagttgctaggtaaaggatgataatgatgatgaagatagcagatgcttgaccaggcatggtggctcagctcacacctgtcatcccagcactttgggaagccaagacgggtggatcacctgaagtcaaggagttcaagaccaggctggccaacatggtaaaaccccatgtttactaaaaatacaaaaattagccaggcatggtggtgcatgcctataatcccagctactcaggaggctgaggcaggagaattgcttgcatctgggaggtggaggttgcagtgagctgaatccgtgccactgcactccagcctgggtgacagagcgaaagtctgtctccaaaaataaataaatagataaataaggccaggtgcagtggttcatgcctgtaatcctagcactttgggaggctgaggtgggtggatcacgaggtcaggagatcgagaccatcctggctaacacggtgaaaccccaactctactaaaaaaaaaagtacaaaaaattagccggacgtggtggcacacgcttgtagtcccagctactcgggaggctaaggcaggagaatagcttgagcctgggagacagaggttgtagtgagccgagatcgcaccactgcactccagcctgggcgacagggtgagactccatcttaaaaaaaaaaaaaaaagaggatagcagacacttttatagtgcttattgtcccaggtgccattctaaggactttatataatttcagcacttatcctcacagaaacctgaagagggaagtattgttatctccattctacagatgaggaaactgaggcacaaagaagttaagtgatttgtctaaggtttcacagctacacttcctaagaaagtcttaggactggctgggtgtggtggctcacgcctataattccagcactttgggaggccaaggtgggcagatcacctgaggttgggagtttgagaccagcctgaccaacatggagaaactccatctctactaaaaatgcaaaattagctgggcatggtggtgcatgcctgtaatcccaactaatcaggaggctgaggcaggagaatcacttgaacccgggaggcagaggttgcggtaagccaagactgcggcactgcactccagcctgggcaacaagagtgaaactctgtctcaaaaaaagaaaaaaaaaaaaaaaaaggcttaggactaagctgtgatgcatatctcaaccaggatccaccccagctgtgtccaagtccccacttagcctccctacttccctgaggtggggacttctttttttttttttgagacggagtctcattctgtctcccaggatggagtgcagtggtgcgatcttggctcactgcaagctctgcctcccgggttcacgccattctcctgcctcagcctcccgagtagctgggactacaggtgcccaccaccatgcccggctaattttttttttttttttttgtatttttagtagagatggggtttcaccgtgttagccaggatggactcgatctcctgaccttgtgatccgcctgcttcggcctcccaaagtactgggattacaggcatgagccaccatgcccggccaaggtggggacttctgacccaagacccagacccttaccggtcattgtcctcatccagcgagaccctttcaaagtgcaggtgcagccggcgcccctcagctgcttcaatgacccaacggcaggtgaggttgggccctacggctcccccaggctctggggacacgatgcggcccagggtggcattgtggatggtgccaccacaggatgctgtgggcagaggaggggtacgttaaggccagcctgaggtgaactgtccttctcctcggggcctcggcccgttttcagaactgttgcattcacacatttggctgggacccggcccagggctggcctctgtcccatggagtcactccagaggatgggaccttctccaggcatgagccaggaaagaaaccagccccggtacgggagaaccccaggattgacacctcctaggatggagacaccactaaaatgaagactctccaactgcggatactctaggatggggagttacaaggatccctaaaattcaaagcctcagctgggaaatcttcaggacaggactttcagagtgaagacaccacgggatgggaatcccagtaagaggctctctaggatagaagccctctggacatgaaccctaaaaatggcttcctctaggatgaggacgctaccccagaagggacctccagaatggtgactcccaaaataaaatctccagtgggacaccccgagatggagaccacccaaggatggagaaaccccaaggagagagaccctccgcacaaagagctctggctgcagaccccaggatggggactcctcagggtaaacaccccttcagaatgggttttccccaaaggtggacacctggacacccccgagataggaccctcccaatggggttcccagaacagatgccccacccactgtggcaggagactcacccatgcagctgggggtttcaccgttccaggatggccgggtgccattgaggcagatgagggtctcctctccctgcagctggtagcccgaatcacagtgaaaggtggcagtgcccccagggtgcaggtccgtcacactcacgtccccatgggccggccggggagggaagccacagctcaggaggtaggctgcaccagacagacagcgggtagcagggctcactttcccatgccaccctctcatactgatcccccagcacttcccccctctcctttcaggccaaccttccaggggcacacactggctccatactggcgtacataccgagaaataagagctcctcacacaggcaccttgcctcgcgaacaggaaactccaacaccccttatctcccccactcattgtaattcaccctcgttggcccccattttatagatgaggtatctgaggttcaaacaagttattctggaccccgctactcatttgttgtgtgacttcaggcaaatcaatgaactactctgaacttcatccagctgtaataacagtatttgcagagcttgttcagctcccaaagtgagtccacacagagattttgaggtcagcagacaaagattatgtgacctggctaggcatgctggctcacgcctgtaatcccagcacttttggaggccgaggcaggtggatcacgaagtcaggagttcgagaccagcctggccaacatggtaaaaccccgtctctaaaaaatacgaaaattagccaggcgtggtggtgggtgcctgtaatcccagctacttggtaggctgaggcaggagaatcacttgaacccaggaggcagaggttgcagtgagccgagatcgtcccattgcactccagcctgggcgacaagagcaaaactctgtctcaaaaaaaaaaagattatgtgacctgttttgcaggtgtgaacactgaggctccaagttattaaatgtctcttttgatttttcttccctccacacacacagcctttcttccaccaaggtgccctgtggtataccctcagctcctcagcttccatccagaagaaccacttgaaacttctttttttttttttttttttttttttttttttgagatagggtctcactgtgttgcccaggctggagtgcagtggtgtgatcatagctcactggaaccttgaactcctggcctcaagcaatcctcctgacccagcctcccaagtagctgggactacaggtttgtgccaccatgccccgctaatttttaaattttttgtagagatgacatctcagtatgttgcccaggctggtcttgaactcctggcctcaagcaaacatgaaacttgttgaggaaatttgactattttgtctttttgtttttgtttttgtttttgaggagaagtctcactctgttgcccaggctggagtgcattggcgcaatctcggctcactgcaacctccgtctcccgggttcaagcggttctcctgcctcagcctcccaagtagctgggattacaggtgtgtgcgaccatgcctagctaatttttgtatttttagtagagatgggattttaccatgttggccagggtggtctcgaactcctgatctcttcagacctcctgacttcactttcactgggggattcatttacaggccactgagtattaagatctttaaagacaaaatagtctttaaaggcacagtggctcacgcctgtaatcctggcactttgggaggctgaggcgggcggatcacctgaggtcaggaaaaagacccaggccttgtcctcaggagtccattgtctactgagatgaacataagaacaaccttctagaacaaagtggtttcaataaatggtagctttgggaatggctgcccatgcccaacagaatcaagtctgaatgctttagtttgacattcaagccccttccatagttaaatgcagcccagcacattccaggttcagggttgatctcccaagaccgatatagcctacacaacacagttttgtgactccttaattttccacctccatattttcgcttgtgctctccccctactttctcatcttttaagagatcagactggggggcttatgtaccacctcttccaggaagccttcctgactctacatctctccaacagttacttgttctcttacctgtacacagtcctgcatgcatgattttgtcatcacattaaccattgtctttttttttttttttttttttttttgagagggtctcactctgtcacccagtctggagtgcagtggcttgatctcagctcattgcaacttttacctcccgggttcaagtaattctcctccctcagcctcccaagtagctgggattataggcgtgtgccacgactcctggctaattttggtatttttattattatttattttattattattattttttgagacggagtattgctctgtcacccaggctggagtgcagtgacacgatcttggctcactgcaacctccgtctcccaggttcaagcaattctccggcctcagcctcctgagtagctgggattacaggcatgtgccaccatgcccagctaatttctgtatttttagtagagacggtgtttcaccatgttggtcaggctggtctcgaactcctgacctcgtgatctgcccgcctcggcctcccaaagtgctgtgattacaggcgtgaaccactgtgctggtattttcagtacagacagtgtttcactatgttggccaggctggtcttgaactcctgacctcaggtgatccacctaccttggcctcccaaagtgctgggattacaggcgtgagccaccatacctggcctaaccactgtctacactggcccaagccttatttattttgtgtcctaaaaggctagtctatgaggtcaggagttccagaccagcctggccaatatggtgaaaccctgtctctaataaaaatacaaaaaattagctgggcatggtggcacacgcctataatcccagctactcaggaggctgagacaggagaatcgcttgaaccaagggggcggaggttgcagggagctgagattgtgccattgcactccagcctgggcagcagagtgagactccgtctcaaaaaaaaaaaagggctagcctggctgatcaatgggtgcagccaagaggcagcatggatcggtgcaaagaccactggatttgtcatcaggcagacctgagttccagttctagctccagaacttactaactacatgcctttgagcaggtgacttcatctctaggggcctctcacctattaacggcaataataattcctatcagggaagattggcctgaaaattaaataaaagaaacacgcaaagcacctggcacatagaagctgctgagaaaacgttaatcacccacccctcagcctcaattaatgaatgactgggagccagggactcggggatctgttgtctggctgcaataaacgtgcagatggttgagcaatctacataacctttgagtcttttccttcctttgagagatagaactgacaatggccactctcagggtttctgtgagaagcaaatgaaactaaggttggtgaaagggctttgtaatgggaaagtttgctgaacttggggtgaggggtgaaggagactttggcttttcagagaaactaatgaggccactctggaccagaggccccagctagtgcaggttgggaagggctgaaacagggccttggtcccaaaggtacccagtgcagctgcgaagcagggaagactgagcaatgaaggccaatttgtgcaatagtcctgcttccccaaatgttccacttagcctaaggagtcctattttcagtgccctggggaagtggctgcttaaaggagccagtggggagccatatcttcagatttcacaatatctgaaatccagcacttggcccaggccctccaggaatgctcttgctccccaataaccaggtccctactgccaaatacacgtcccccagcttgctggcccccgatgaataggcacctttgctatgcacacatgagcccctaaggcaggtcctgagcagaggcctcaaaagaggctggagaggacatgagaataggattcagggtgtaccctgcatgaggcacacaaggcatctgcggtcagcagagctttcaaggagggcagagtgcgtgacaccagccaaggccatgcggtgatgtgaagggggcattggcccgacacacagttctctctgtctccatgaagcataggaagacagtggggtctggaacagggcactggctgggcccctttcctcatgcacacatgtctgctagaacacacccttgtactgtgggaaggttcccgcacacacaggtaagcatggatgtacacacatgtgcaggtcatctgtcataggtcctaacaaatgcagtcgtgcgtgaatacagcccccctttcctgcccccagaagtcagaaggatctttaaattgcaaatctgaggctttcactttcctgcttaaaacatttcaggccaggcaccatggctcacgcctgtaatctcagcactttgggaggtcaaggcaggaggatttcctgaggtcgggagttcgagaccagcctgaccaacatggagaaaccccgtctctactaaaaatacaaagttagccgggagtggtggggcatgcttgtaatcccagctactcaggaggctgaggcaggagaatcgcttgaacccgggaggcagaggctgcggtgagccaagattgcgccattgcattccagcctggccaacaagagcaaaactccatctcaaataaataaataaataaataaataaaattcaaattaggaggcctggcgtggtggctcatgcctgtaatcccagcactttgggaggccaaggcgggtggatcacttgaggtcaggagttcgagaccagcctggccaacatggtgaaaccccatctctactaaaaatacaaaaattagccaggcgtagtggcaggtgcctgtaatcccagatactggggaggctgagacaggagaatcatctgaagctaggaggcagaggttgcagtgagctgaggtcatcaccactgcactccagcctgggcaacaaagtgagactctgtctcaaaaaaaaaaaaaaaaaaattcaaatatctgcctgtcacacctgcaggttgaagtagtctggactgcttactgaagcagataaggctctttatggtctgaatctgacctgcctcccagcctggtctctggcccatttccccttcacccgcttctgtgctttgaaagtaatagcagtgactgacagttttgagctctcactgtgtaccacacgctgtttgtgtttttgtttgtttgtttttgagacagagtttcacttttgtcacctagcctggagtacaatggcgcaatctcagctcaatgcaacctccgcctcctgggttcaaacaattctcttgcctcagcctcccaagtaactgggattacaggtgcttgccaccatgcctggctaatttttgtaattttagtagagatggggtttcaccatgttggccaggcaggtcttgaactcctgacctcaggtgatccaccagccttggcctcccaaagtgctgagattataggcgtgagccaccacgccaggccacacactgttttaaacacttgacatgtattaattcatttgatcttccccataatactaagtattgtgatccctatttttcagatgagatcatgaggcacagaaaagttaagtaacttgtcccaggtcacacagctaggacaattctatcttccatgctgaattccttcacctcatctgggggtcatgtcttctctctctgggtcttggagtgtgctttttcatccacttagccatctgcctccctccttctctccctccctcccaccctttccctggcgaatttatccttcaggtctcagcttagtcatcatctcctccaagaagatgtccccatattccttgggagaaatttaggtcccttggctatgtgctgcccccgctggtgtttctgccatcatattccttatctccttgaattataaccatcctgattactcatctgtcttcctacctagattctgagctcgttgaagccagatttacacctggtttgttcattcctccttcaaggctaacacagggcctggtatgaagcaagcacttgataaacatttgttggattcaatggatgaattgtccctcggatgtgtgcacagatctgtgagtgtgtgagataagtatgcatgggtctcctctgagggccctgccccccagggtcgcagtcaggaggaaaagcccccttcggcaccctgtgcttcgatggttcttaaagatgtcccctctataggccgggcacagtggctcttgcctgtaatcccagcactttgggaggctgaggcaggtggatcacaaagtcaggagatcgagaccatcctggctaacgcggtgaaatcccatctctactaaaaatacaaaaaattagctgggcatggtggcgggcgtctgtagtcccagctacttgagaggctgaggcaggagaatggcgtgaacctgggaggcagagcttgcagtgagctgagatcacgccactgacctccagtctgggcgacagagcaagactctgtctcaaaaaaaaaaaaaaaaaaaaagatgtccagtgtatgcagtatggcccctgcccttccagcagcaccctcaaactcctcaccctgatagtggatcctgaagccaccgccccttgggacccgtgggctctggaagtgcagaagcagccggttggttgggctccgaaggacttgtccttctccaagcatggatgagttggccaggagtcggggggccaggcctggggatcccccaccagccagcaccaggagctcctcttcctgtgacaggttcagcgtctgcacctagagaagccagacacagacccgccagggcaagtcagccaggtgtttgacttccaaagcccctgtcctgtgcctttgccctgtgtgtagcagcccaaaaggcaccacgctgctgcccaagttgtagaaatctagaagagtttttgaggtcacctgagtcatcagacaggttctttggctcccaggccaaacccgtgcacacccacagcccagaggaaaaggcttggaagctgcacagtcacatgctttggtccagttacctggatctcaatgccgtagccagggtagacatggatgctgtaagtgcagtccaggagccccagggtgcggctgacggggctccccagatctggagactccacatacccttcgccctcggagatgttgttattacacagaactgaggagatacaaatggctgggatggaaggaatgcctgtgcttttgccctcccagccaagcaactctggccttcatctcccttctccttagcacttctcatcatctttttgttttgtttgagacagggtctcgctctgtcacccaggctggagtgcagtggtgcaatcatggctcactgcagtctcaaattcctgggctcaagtgatcctccctcctcagcctcccgagtagctgggcccacaggtgcacatcaccatggtgagacaatttttaaaactttttgtagaaatggggtcttgccacatttcccaggctggactcaaactcctggcctcaagcgatcctcctgccttggcctcccaaatcactgggattacagctgtgcgctgctgtgcccccctcaccatcttttatttttttatttttatttttttaagatggagttttgctcttgttgcctaggctagagtgcaatggctggatctcagctcaccacaacctccacctcccgggttcaagcaattctcctgcctcagccttctgagtagctgggattacaggcatgcgccaccacgcctggctaattttgtatttttagtagagacagggtttctccatgttgctcaggctggtctcgaactcccgacctcaggtgatctgcccgcctggcctcccaaagtgctgggattacaggctagagccaccatgtccatcactatctttaagcaatgctccctctcccacctgagccagaactccctttcccaactgttatatagctgaaacaattggaacactgcctggtacatagtaagggtacagaaatgctacctttgttattattattctcccatctgtacccaggactccttccacagttcccagcagcctctctcccatccatccccagcgtgtacctctccggtcctcccacccccatccccttgctgtcgcctcacctgggctggtcaccgtagtggtaacagttgtcgtggtgatgatggtggtcgtcgtctcctcctctcctccctcaggcccaaggggaggccctggggaggcagggctgggtgggggtggggctgtggttcctgggggcggggtcagcagttctggcgcagtggggcctgcccccctgaccccgttaggggtgacggctgttgtcagaggccctgtccccggctcagtggcccgtggcagggagggcactgcgagagtctggccggccggaggggtggctagcgtggggtcccgatcagatcctgggacagtgcagggaatatcagagcacaggaggagcacatggaggaccttgggtggggagcagggctgagggaagctaggggttcccctgccataccacaaaagcctcccgcacaaggtacagcaccccccacctttcccttccccaccccagcccctacctcctcccaaggcttccacagcctgagtcccccctctttctcttctggtcccttctctccacccagccccttccaccctgatactcctctccctgagcctctctctctgcctcctcactcagatcacgttctctctctggttatctcctctctcctctgtctcattctctctcgaactctttatttccccatttccctgtttagtattctgattgcactctgatttcatgattcgagatccactagtttttgtgtttcattctctctgtctctgtcttccaccatttctctgagtctggttctctgaatttccatctctgtttctatgtgtctgtttttctgtctgactgtcacctaatcattctgtctctgtctctctggttctgtctgtgcccaggtttgactttctctgacagtctcgttctgtgttccctgaatctcacaggaatgcaggctctttcctctgcagtctctctctgcctgctcttctctagcctggctccccatctccctgagcccatatccctccctctgcctctaggccactcctgccactctgggggcctcacctggcaggtagcccatctctgggcccctcctcagcagggccccatgaagcagttcagccagggcctcagaggccaccgtgggggtctcacttccaggctctggcaatatctcctcctccttcaggggcagacctaggaggtgaagttgtgtgagcttctccacttccccacaccccttccttctccagagagatattttctagaactcttcctccctcctccatcagctgggcctgcaggggctcagatggtcccaggctcgactgagggccaagatcggaggaggggctcccagctgccctcatactcccactcccacacctcttctctcccctcccctctcccttctccctgggctgtgtgggccttcattgaacaccttagctcttatggaccctggacagcgccagcaaggcagaggggtcgccggtgctgccttccctttcacctcagtggtgatctccccccaaccctggggctctgcagaggatctggccgcacctcccagcccttgcttccgcagtgcctggctttctctctgggtttctgtctctgcagtgtggctgtcttttctctctctctctctctctctctcccccccaccctctctctctctggtcctctgcagtctctgcctccttccctggagtctggctgggggtcagagtgggggactgaaaatctggtctttgagccctgcctctgctcatctgtctttgtccattcatccaagaacagttgtgtgtacagcgcctggcatctctctcagcacctccatctcccacccaggtccctccatgcttctgccgcctccgcagacatccccccaactttcccagccctccttcttggatctagcccctgagacactgctaaaagcttctctcattcatttctctgccttctcaatattgagggttaaggggcttcgggttcaagcctgaaagctctggcttgccccttccccatcagctgtgcctctcccctcccccatgtgctcggaagacccaggatattaagagaaaggagggtggaggaccccgctggacgccttcctggggcccacccccacagtctcatgtccttaccctggatccagggacagctcagcagaattaggaacagcagctggggaggcggcgggtgctgggccctgggagtccccatggcgactcaccccgatctctctcctctgtgcctctctaagtaatctggctgccacctttcctccgtctccgtttatctttccctttaattgttttttttttttttttttttttcctcgtaggagtcagcaaagaaagacaatttctctgccccttgggatggaggggcagaattgggctaggggtcgcctggagcccacccccctttgctcagtctcctctgtcctcttctcg

SEQ ID NO: 67 - DNA, 5231 bp, Homo sapiens
tgaggtgggagagagaagcagagcgagagagaggaggctgctggaaggagaaagaagagggtgaggaggcgacagagggagaggaggaagaagaggtagaaggagagagaaaggggagagaaaggagagaggagggttggaggtgcatgaaggaggggagagggagcttcagcgtggagagaggaccgcggaaggagagagagacagcccagagtggaatgtggaagggaaacagtccagcggggagccagggggcagccatggaagggacaggtggggagctggggggacaggggaactggggtccggaggacgccccaggcctcttggccagggcctccctgatcatgctcccgtggccactacccctggcctcctcggccctcaccttgctcttcggggccctcacttccctgttcctctggtactgctaccgcctgggctcccaagacatgcaggccctaggggctgggagccgagctgggggtgttcgtggtgggcctgtgggatgctcggaggccggcgggccaagcccagggggtcctggggatcccggggaaggacctaggacggaaggcctagtgagccggcggcttcgggcctacgcaaggcgctactcctgggctgggatgggtagagtgaggcgggcagctcagggtggcccaggccctgggagagggccaggggtcctaggtattcagcgcccaggcctgcttttcctaccagacctgccttcagccccctttgtgccgcgggacgcccagcggcacgacgtggagctcctggagagcagcttccctgccattttgcgggacttcggggctgtgagctgggacttctcagggactacccctccgcctcggggctggtccccacctctggcccccgggtgctaccagctcctgctgtaccaagcaggccggtgccaacccagcaactgccgccggtgcccgggggcctatcgggcactgagggggcttcgaagctttatgagtgccaacaccttcggcaatgccggcttttccgttctcctgcctggggcccggctcgagggccgctgtgggcccaccaatgcccgggtcagatgccatctgggtaagtagctgccgcctactgacaacctccttgcctcgatgatttcccccccagacccttctctccgccagagccgtctgctgtctggttctcattgtgcctctcttcttccatggctccctgttgccacccacagcagcatttcctcagcctcggttatctgcacaccaccttcataagctttgccgtggtcattcccatctgtactgcgtttcttcaccttggctctccccccgaccttttgttctacgtatttaaaagaaatatttatagcactatcagtattacttgccctaaatagtactcataaaaagcctggacaacacagtgagaccttgtctctacaaataataaaacaattagccgggcgcggtggcccatgcctatggtcccagctactggagagggtgaggtgggaggttcactggagctcagcagtttgaggctgcagtgagctgagattgtgctactgcactccagcctgggtgacaagaaagtactcataaacacaagctgaaatttaaaaaagaaagctttcaacagtctagaacattctagttaagtgctctagtctctctgatcctgaagcctacacttttttcttttttgaggagtctcgctctgtcgcccaggcgagagtgcagtggcacgatcttggctcactgcaagctccacctcccgggttcataccattctcctgcctcagcctcccgagtatctgggactacaggcacctgccactacacctggctaatttttttttattttgtatttttagtgaagacagggtttcaccatgttagccaggatggtctccatctcctgacctcgtgatcaatccgcctcggcctcccaaagtgctgggattacaggcatgagccaccgtgcctagccctacaccttcttttttaaaagggttggtggggtgtcaaagttacagtagcaccaaactgagattttttctttttcttttttttttttttttgagacagggtctcactctgtcacccaggctggagtgcagtggcacaaacatggctcactacagccttaacctcctgagatcaaaggatcctctcacctcagcctcctgagtagctgggaccacaggtgcccaccaccatgcttggctgattttttaaaaatttacgtaggccaggcgcggtggctcacgcctgtaatcccagcactttgggaggctgaggcaggcggatcacctgaggctgggagttcgagaccagctgaccaacatggagaaatcctgtctctactaaaattacagaaaattagctgggtgtggtgtcgcatgcctgtaatcccagctactcgggaggccgaggcaggagaatcacttgaactcgggaggcggaggttgcagtgagccgagatcacaacattgcactccagcctgggcaacaagagcgaaacttcatctcaaaaacaagaaaaaaaaattgtgtaaagacaggctggacctgaactcctgaactcaagtgatcctcctgccttggcctcccaaagtgctgagattacaggcgtgagccaccgcacctggcactttttgatgtcttaaagactggaagaaaatggaaaaggaaataattttctgttattccatgccatgaccttgttttgcccccaatcatctcctgtgctgccagctggatgtgtcctacacttcagggcacactagcctcaggatcagttcccaatccttcctctcttccctctctctgtgctctaaatcatgaaaaccttctggccaatcctgacagatgccacatgtgctgttcttttcaacctagaatccccttcccccgtaccacctcctgaaaaactcctactcagccttcagtactcaagttttcaagtgccacacttcctctgggttggcttcctgttcccccatcagttgagttggctgctcactttcctcacagcactcagccatgtggtccttgggccaggaacgtctttaatcttatacctctcagtgagacagcgcctatcacacagtaagctcttgagtcaaactgtcgaaagcccaggaggaaaagccatttcctccaggaagccttctcttttctcgaaatgagaggttgctgccaggtgccgtggctcatccctgaaataccagcactttgggaggccaaagcaggaggattgcttgaggccaggagttcaagaccagcactgtctgtataagaataaaataaaataaaataaaataaaataacgggtctggccaggtgcagtggctcacacctgtaatcccagcattttgggaggctgaggtaggcagatcacttgagctcaggggttcgagaccagcctggccaacatggcgaaaccccatctctactaaaaatacaaaaattagccaggcgtggtggcaggcagctgtaatcctagctactcgggaggctgaggcaggagaattgcttgaacctgggaggcggaggttgcagtgagccaagatcatgccactgcactccaacctggcgacagagcaagactacatctcaaaaaaaaaaacaaaacaaaaaattaaccctgcattgtagcacatgcctgtaatcccagcagctactcaggaggctgagacacgagaatcacttgaacctgggaagcagagtgagctgagatcacaccactccactccagcctgggtgagagagtgagactttgtctcaaaaaaaaaaaaaaaaaaaagatgggtcacactacccacagcagcgtttccctaatctcctagcacttccctcctccaggactgtattgtaattatactgtggccactttctggaaagaaaggaggatgaccacaaaacctggcatttaagacacttagagctagttgctaattgactggccaggatgggcccctgggatggaggcaggagtgctggatgcccgcgtctcttcttacaggcctaaagatccctcctggctgtgagctggtggtcggcggtgagccccagtgctgggctgaggggcactgtctactggtggacgactcttttctacacacagtggctcacaatggtaacggggtgcccattctgcaggggggatgagggactcaggagcaaaggagcgttgactagaaggcagcagaatcaggcccaacggacttcctgtcctaccaccaccatcttccagctgcatgaccttgaacaagccgcataacttctccaatgccctaggaccaccaccttcttcatcaagtaactgcaaggattaaatgagataatattacgtacacagaaaagcggttaccagcacaggactctgggttcctgtcctacctcttgcacttgggcaaaggacttaacctccttatgcctctgttgctttgtataaaatagggataattatggtaataccacagtttgttttgatgattaagagttgatacatatcggccgggcatggtggctcacgcctgtaatcccagcactttgggaggctgaggtgggcggatcacctgaggccaggagttcgagaccagcctggccaacatggtgaaaccccgtctctattaaacatacaaagaaattacccaggtgtggtgatgagcacctgaaatcccagctactagggagactgaggcaggagaattgcttgaacctgggaggccaaggttgcagtgagccgaaattgcgccactgcactccagcctggtgacagagcaagactccatctcaggaaaaaaaaaaaaaaaaaaaaaaaagatttgatacatttaaagggttagaacaaggcctgccacttatttactgtttgcttttatggtgtttggtgagtgctctggtgtgcaagtacctaatgtcagtggctctgctgttcctgtcccatgtgccctaggctcccccgaagatgggcctcgagtggtcttcatcgtggacctctggcaccccaacgtggcaggggctgagcgccaggccctcgactttgtcttcgccccagacccttgaaggaaggtgctcccttcacacacccaggctggagagacactgcgctcagggacggcttgatggtagccaggacctcctctctactgcgggggtgggcgggggcggaggatgggaactggctagtgagcactgaaatataaattctgaatcctctcctaa

SEQ ID NO: 68 - DNA, 19883 bp, Homo sapiens
ctcaacttaactttatttcaataatttaatagaaaattaaaataataaataatatgaaacagactgataacgctgagctgggcaggcccaggccagtctagtacaaagttaaggaggtagggaggatggtggggaggagggggcggactaccctgcaggacgcgggaggctgctcagactgtggtgatgtcaggaagggccgcacactttggcatggacgatgcactaaaaaaagagaaagggaattctaaatccctcttaaccagctggagagggaaggacgcagggccagggtggggacaagtgttggcttcggaaggctctgagtggtggggccggaatgtaccatgttgttagcaatggggttgggatgggtggagaagggccaaagtgagctgtgccatgcaatgaagggacagaggaggacccacgacttggccagcagagccggggcaaaagtctgggaaggggagggaaagagagagggactgggtcccaaggcaagaggaaggcagggggagggtcagaggtcagtccttgaagacaatttgttggccatgaggacgctcgtcgtgggtgatatggcgccggacatggatcctgcggacacggtgctctcggttctcttcatcctccccgcggccagccccaccagctccagctgctccccctgtggcctccaggagggctgggtctgggccccggggagtctcgtagatgaggatgttcagggtctcctcgaagatccgggcctctggaaattccacctgcaaaaggccagccggccccagctccttccttctggtgcagtcacgcagggccatccccctgcctagggcccctgcaccaacacacctcctagccctgcagtcaggtccttgggcctggcctggcctctctgccactcctttactcagcaaagtcatacttcaaggctcagctctgaagtcaggcaggcagaattatttgttttctctccttcatctccttccctgcctagcctcttggtatattttttcatttgacaaatactgagtgagtgcactgcaccaggtattgttctaggcactgcaaaaatagcagtgaacaaaacaagagttctgtcctcaggaggttacattctagtgggaggactcagtcatacacttaagaaaatataaactagcctggcgcagtgactcaggcctgtaatcccagcactttgggaggccaaggtgggaggacagcttgaggccaggagtttgagtctagtctgggcaacatggtgtaaccccatctctaccaaaaatacaaaaaattagctaggtgtggtggcccacacctgtgttcccagctactcgggagactgaggtgggaggatcacctgagcatgggaggtggaggttgcagtgagccaagattgtaccactgcactccaacctgggtgacagtgagaccccatctcaaaataaataaataaataaataaaataaaatataaatgcagtcaaatgatgatgtttaggaaacgatataagctgggtgtggtgtctcctgactgtaatcccagcacattgggaggctaaggcaggaacatcgttagagcccaggagttcaagttcaaagccagcctgggcaatgtagcaagacctcatctattaaaaaaaaaaaaagagagagagagagaaagagatacatcaggaaaagagatacatcaggaaaaggggatgtgatagccagagccaggagtgttacaactttaagaaggactccagggaaggcctcactgagaaggtgatatttgaccaaaggagtgggggaggggacaaggcacacagagcagaaagagcagcctggggagggccagggccagcgtgagagctgtgggtcaggagtgcacccagtgtcttactggaagatcaaaagggaggccaatgcaattgaggcagagatgagagggaatggaaagggatgaagtcgaagaggtgactggggtgttcccttgtgtggccttggaagcatctaacacagctcttagcaaactgtttttttaattttttatttttattttttattttttcctgagacagagtcttgctctgtcacccaggctggagcgcaatggcacaatctcagctcactgcaacctccacttcccaagttcaagcgattttcctgcttcaacctcccggagtagctgggattacaggcatgtgccattatgcccagctaatttttggatttttagtagagacagggtttcaccatgttgtacaggctggtctcgaactcctgacctcgtgatctgcccgcctcagcctcccaaagtgctgggattacaggtgtgagccaccatgcccggccttttttttttttttttaatcgttgtttgtttgtttctaagacaagatctcactctgttgcctaggctggagtgcagtggtgtgatcatgtatccctgcagcctcaacctcccgggctcaagtgatcctcccacctcagcttcctgagtacctgggtgtaccactatgtccagttaatttttttttattttttgtagagatggggtcttgctgtgttgcccaggctggcctcaaactcctggccttaatggtcccctgcctcagcctcctaaagtattgggattacaggtgtgagccatgcactctaattattggtttatcttcctatcttcccaatcagaggatgtttcttggaagctgggtcactgattcattcattcattcattcaataaatgtttcctagcttccactgtgtgaaaagggcccagctaatgggagataggaaagaaaaagacatggccctgccctcaaggaactaacacctcgctgctgatgcaaaccccctcccctccaccacacatgataaaacactgtctttagctatgaagggagtgtgaccaactttggggttgctggattgaaagttcatgagtgaaggtgacccaaagaaagtgatgcttagcttgagtcttaagattaagtacaagttcattaggcagatagaaggaaagaattccaagaggcaacagtgtgtgcagaggtaagaggtaagaaatagcactgagtgcttagagacttgtgatgactgtggtgtacctgaggcatgtggctcatagtaagctcggaagggaccagatgaggaagggcttgtattttgctcagcacttcattccccttgatttccagcccggtacagtacttagcacagagcaggggcttggggaatatcttgatgattgccacattaatgactcaggatctacaaactcagaggatgttctaagagacatctgattctgaggttttaagaatctatttttggcaatgggcctttctgagtttcccttttttttttttttaattagagttagggctcactctgtctcctaggatggagtgcagtggcatgatcatagctccctgctgcctcaaattcctgggctagggcgggcccggtggctcacacctataatccaagcactttgggaggccgaggagggcagatcacttgaggtcaggggttcaataccagcctgaccaacatggcgaagtctctactaaagagacttctctactacatttagtctctactaaaaaatacaaaaattagccgggcatggaggcgggtgcctgtagtgccagctacttgggaggctgaggcaggagaatcacttgaatctgggaggcagaggttaagtgagctgagatcacaccattgcactgcagcttgggcaacagagtgagactctgtctaaaaaaaaaaaaaaaaaaataggctgggggcagtggctcacgcttgtaatcccagcactttgggaggctgaggtgggtggatcacgaggtcaagagattgagaccatcctggccaacatggtgaaaccccgtttctactaaaaatacaaaaattagctgggcatggtggcacgtgcctgtagtcctagctactggggaggctgaggcagaagaatcgcttgaacctgggaggtagaggttgcggtgagcggagattgtgccactgcactacagcctggtgacacaacgagactccatctcaaataataataataataataataaataaataaattactgggctcaagcaatcctcctgccttagcttcctgagtagctgggattacaggtgcatgccatcatgtcaccaagccaccacacctggctaaattttttgacttcttacagagatcaggtcccacgatgttgcccaggctggtctcgaactcctgggctcaagtgatcctcctgccttggcctcccagagtcctggggttacaggcgtaagccactatgcctcaccccttctgagtttctaatggcaactatggaccccctatacagaaaaatgcatacacccccatttcaggagttgcaaacagccttgaaacccatccaacaggcctaggctaagcaccctgctctaacccgtgacccccatttcacagagaaacagagacccacagggatagggtggcttgcccactgttgtgcaccccagaccccaggatctggctcctgcctcctggtggtgggctccttcccctgccaacctgcttttgtccagggtcctggtcctggccacccccagcccccaacataggctctggagcccctctgaccttggtctgcttcttctccgtagcatagacaatggaggtgcagcacacctcggcgattttgcggccctgcccgtagaaagaccagcagcagatctcgtcccccaggacatccttgaggaagagtagccgcccgtggaagcgcagggccagcttgtcgaacagctcgatgttcttaagtaggttgtcatctgaagtgctggggaccaggggaccaggaggcctcagcgcagttggcacccctccctctgtacccccagaagacgggcctggatgcattcccagtcctctgctcctgcccagggctttggtgctcaacagagagcctcctccacccctggggccaggctaaacgggtctcagaagggaagccacatgcgctgagcaaatcccagcacagcacagcacagcagctccagtgagggaccgggagccaggccacctccccgggggtcctggtgtccccattttttaactgggtgacactaggcaagttacttcacctcttggtgtcccgacctcctcatctgtaaaatggagctcacaacagtactgacctcaagggggaggactctgccagttcctagaatgagagcacttgggataggctcgccactatcactttgtcctcacccaaacccatttactgatgactgagctgaagctgagaagcagaaaggacctgcctagagcgtcaggggtaagaggcgaagccgaatctgcgagcaggcacagatgttcttgtaggccccccgtgtggccgtggccctcgccttgggcagaagcagggctgtgctgcatcccagggtcccgcccagtgccccgcaccccggcggtcacctggtgtaggagtacttgttgttactgcggttgtgcaggagcttcaccacgggctggcgggggagagaggatggacgagaggggtgaggctgcagggagaggcccccccagtgagcctccaccctgcagggcttgggggcctcaccttggaggtgctggccaggagctgctgctcctcccggggagatgtcaccatggggatgaggcacagcggggacagcgtctcccttttttgctggggaagaagcggaaggtggttaacagcacaaccaaaggccacgtactcccccacttaaaagccttcaaaagctggttgggaacaactccagactcctcagtggtccgcagggctctgcaggctccaagctccgccagcctctctgccactctccctttgcttgctgggccttggtcccacggacaccttgctgcttcacacatccagcttgtgcctgccccggccactggctgtgcccctgcccgggatgcttctttgctcagctgtcagcgtggcgtgtccgtcatgccattcagatcgcaggtcacacagtgcctcctcagggccagccctccccagcccccctggctaaaacagcctcctctacatcctgccttttgtgttatcagttttctttttctttttttgagacagagtttcgcttgttgcccaggctggagtgcaatggcgccatctcggctcactgcaacctccacctcccgggttaaagcaattctcctgcctcagcctcctgagtagctgggattacaggcatgtgccaccacacccagctaattttgtatttttagtagagacgaggtttctccatgttggtcaggctggtcatgaactcccgaactcaggtgatcagcccgcctcagcctcccaaagtgctgggattacaggcgtgagccactgcaccaggcctatcagttcattttctacacagcagttagtgtctgactttttctaactttttgtatttgtttatgatctgtctcttcccacctaggaataactacctagtatacagctgatgctctgtatttgttgaatgaatgaacatatttgttgagtgaatgaacttcattgggtgggatgacgttggagaaagaaatctgaagcaaacccatgggcttctttctcttctgtcttctagaatcttcatgccaaaatccctctcacttctcccaaccttgaaaactcaatgcgcaattctaatacaaattccagatttgttttttgcagaaactcataagactctctaaaattaacagagaataataaaagtctacaattactgaggccattttttttttttttttttttttgagacagggtcttgctgtcatccaggctgagtgcagtggcatgaccacagcttacagcagccttgacctcctgggctcaagccatcctcccaaacttaggtcagtttttaaaaataagagcaaagaggaaaggccgaccctgccagatattaagataggctgcaaagccacaacagtgagaacggtatcagttcgggcacagaaacaaaaatacctgagaaacacaacagagcgatcagaaacagaccactgtgtatatgagaattggtatttttaaaaagacaccacaaatgtgcgaggggaattacggagtatgaattcgttatctatcactgtgtaacaaactgcccccaatttaggagcttaaattaacaatatttattacttctgtttctgagggtcaggatctcagcagtggctcggctgggtggctccggcacagggtctcttctgaggctgtggccaagatgtcagtggggctgtgggcatcaaaggcatgaccgcccctagaggatgcactctgagaaagcttgttcatgtggctggcaagttcgcactagctgctggcaggaaacaacaaatccctgccatgtagatctctccacagggttgcttgagtatcctcgcagcatggcaactggcttctccagagcaaataattccagagagggcaaggtggaagcctcattgtcttttttatttttgagatggagtctcactgtgtcgcccaggctggagtgcagtggcgtaatatcggctcactgcaacctccgcctcccaggttcaagtgattttcctgcctcaaccacccaagtagctgggattaccgaggtgtgccatcacgcccagctaatttttgtatttttagtagagacagggtttcaccatgttggccaggctggtctcaaactcccgacctcaggtgatccactcgcctcagcctcccaaagtgctgggattacagacgtgagccacagcgccgggcccctccattgtcttttatgacctaggtctgttggtcctatccagtgaggaaggagatgacacacaggaacgagcaccaggggacgagaatcatcaggctgccttggtggctggctccacaggccaccgctggctctcagtgatttcccccctcccacatgccaaatatactcaccaccttccaggatcccccatcatcccattacagcatcagctcaaagtacagaatctcatcatctcagtcaggtccaggtggggatgtggctctagcatgcagttccgtaactatggctccttaagtgcatttcttttttttttttttttttgaaatggagtcttgctctgtctcccaagctgaagtgcagagccaccaccatctcacctcactgaaaactctgcttcccaggttcaagtgattctcttgcctcagcatcccaagtagctgggactacaggcatgcaccaccatcccagctaattttctttagtagagacgggatttcaccatgttggccaggctcgtctttaactcctgacctcaggtgatccacttgccttggcctcccaaagtgttgggattacaggcgtgagccaccgcatccagcccttaagtgcatttcctatctgcagacctgtgagctaaagagacaggtcatctccacactcccagtgtgcagtggtagaggcaggcacaggataaccagtaaggacattcttgctcaaaagcaggggaagccgggcgtggtagcgtgtgcctgtcatcccagctactcaggaggccaaggtgggaggattacttgagcccaggagttcgagaccagcctgggcaacatagcaagactctgtctcaaaaaaaaaaaaaagtggggcaggggacaggaggcacatataagtcatacatataagtcactggtgtgtggaaattctgtaatccagttggagaaatgctaggaactctttgatgcctactcctgttcatgaatgattctccatggctctccctgagtcgtcccacctcttccatgaaagatgtttgcagctccacagtttcatctgcctgcttcctgcctgtaaaagtttgggtgtgcaaagccgtcttgtccttttgcactggctctgtccctttcagtccaagctggcagtgtctctgccaatataattctcttcataacttattgggtatcttgcatgtcttagggttcactacattagaaaaaagccacacctagaaatctctgcaagtggccaggcacagtggctcacgcctgtaatcccagcactttgggaggccgaggtgggtggatcacctgaggtcaggagtttgagactagcctgaccaacatggtgaaaccccatctctactaaaaatacaaaaattagctgggcgtggtggtgggcacctgtaatcgcagctactcaggaggctgagacaggagaatcacttgaacccaggaggaggaggttgcagtgagctatctcaaaaaaaaaaaaaagaaaagaaaaagaaaaaagaaaatctctgcaaggtaagcccttctctactttgggcttgtgctgagacgctgaaagacaacacctttaaccttctcagaagcgtgattattatttcattcgactggaagtcccctctgaggcatcttgttggtatttctgaggtcttaacaaaggactttttcatcacatcctcagcttgacctttagaccacatttccctgtatttaatgccttgtatttaatctttgcacggaagccatttgttaattttaacatcacttgttatctggaaaggctgggaattttcaaacccaacaatttcaggctctttttcatttaagtgttttttttctttaacttactctctcctcttcagttttactataagcagcaagaagccaggtggcaccttcaacattctgtctggaaagctccttagctagaccatccgttccttaggtatatttcctaccctccacactaatgcaggagacagtgttgctaaactttctgccgctacacaaggatctcctttccatcagtttccaatagcattttcctaactgttcttcaagcccttattgcagctgtcttaaaggtcactggactcttattaacagactttctcaccttttttcttttaatttttttagagacaaggtctcactatattgctcaggctggtctcgaactcctgaactcaagtgatcctcccaccttggcctccaaaagttatggtattacaagtgtgaaccactgtgcccagccaatactttttaacactccttaagcttttactaacaatctcctcaaagtccttccagcttcttcccacttctcagttgtaaagttacttctacatttgaggtttctgttatggcagacccccattccagaaaccaaagtctgttctctgttactgggtaacaaattactacaaactcagcagcttaaaacaacagtccaggtgtggaggctcatgcctgtaatctcagcattttgggaggccaaggctggaggactgcttgaggtcaggagttcgagaccagcctggccgacagagcaagactctgtctctatttaaaaataaataaataaaaataaacattatctcacatagtttctgtgggtcaggaatttgggatgggcttagctgggtggccctggcccagaatctgtcatgaagctgcagtctggattttggctagggctgcagtcatcagaaggtttgcctgggcctagaagctctggttctgagacaggtcaccactatggcggggagtctgtgcttgctgtcggcaggggcttcagttcctcaccaagtggacctctgcttagggatgcctgagtgtcctcacatagcattcacatagagtgagtgatctcaaagagaggcagaagctgtaatgtcttttatgacctagcttcaaagtcacatgctgtcatttctgcaatgtcctattggtcatacacaagggtctccttggtgaggatctgaaaaggtctgccctatttggtgtgggaggggactgaacaagagcctggaaaccaggaggcaagaacccctggtggctgtcttgggtgctggctacctctggactgtttaatacctggcactgggaaaactacctcaccctatggaagacaaaaatgagctaaatcccttcacaatcatatttacaaaagtgagttccatttagattaaaatacccatatatgaaaaaaatccatatttaaaactataggtcaggtatagcggatcacacctgtaatcccagcactttgggaggccgaagtgggcagatcgcttgagctcaggagtttgagaccagcttgaccaacatggcaaaaccccctttctacaaaaaatacaaaaattagacgggtgtggtggctcatgcttgtaatcccagcactttgggagaccaaggcgggcggatcacgaggtcaggagttcgagaccagtctggccaacgtcgtgaaaccccatctctgctaaaatacaaaaattagccaggcatggtggtgcacgcctgtaatcccagctactcaggaggttagggcaggagaatcgcttgaacccgggaggcagaggttgcagtgagccgagatcatgccactgcactccagtctgggcaatagagtgagactccatttagaaaaataaaaaataaaaaatcagccaggtgtcatggtgcacgcctgtaatcgcagctactcgggaggctgagacatgaaaattgtttgaacctgggaggtggaggttgcagtgagccgagatgacaccattgaactctaacctgggtgacagatcaagactctgcctcaaaaaataaaaataaaactacaaagctcacaggtaacagaaaatcagaaaaacatttttaaacaagaccataaggatacagcattaggcaaaaaatggtgaggaattggactacatccaaatcaagaatttttcaagttgacaatggaaagcatgactttacaaataatctcatgtaataatgttgaagagaaaagacttataggtattctgtggcacaaatgtaattactggttcaggtaaggattatcaatttgtgtgtcattgataggtaactgccttaatacagtggccaaataccatatgcattattttatagttagcaacaaggaaatgtaacaatgatagagaaatcaaaccaccatcccctagatccaggggccaattatgaacgtcattaatgacgagtcatattaacaatattatgggttgcttgatgtggcccaacgtgaaatacatacataatattacctaaaatgtattctaaacaaaatgtttaatatcagtcattttatttattttattatttattcatttattttgagacagagtcttgctctgttgaccaggctggagtgcagtggtgcaaccttgactcactgcaacctctgcctcccaggttcatataattcttctgcctcagcctcctgagtaactgggactacaggcacccaccaccactcccagctaatttttgtaattttttatttatttatttatttatttttgagatggagtctcgcactgttgcccaggctggagtgcagtggcacgatctcggctcactgcaacctctgcctccccaggttcaagcgattctcctgcctcagcctcctgagtagctgggattacagatgcccaccaccaggcctggctaatttttttgtatttttagtagatacagggtttcaccatgttggccaggctggtcttgaactcctgaccttgtgatccacctgcctcagcctcccaaagtgctgggattacaggcatgagccaccgcacctggcataatttttgtatttttaatagagatggggtttcaccatgctgaccaggctggtctcaaactcctgacctcaagtgatccacctgccttggcctcccaaagtgctgggattataggcgtgagccaccgtgcccacccaatatcagtcatttaaaatctacagtctggtttacaggaaattaaggataaggctgggtaataaaccaaacgataccgggagtaaacaaccaggcaaagttggaaagcgggtcattgtgcaggacaactggcagtctctttaacaagccagcatcgtgaggaaaaagggaccccttggattgtaataaagtaatgcttatggtattatttggcttatgtaataaagtaatgcttatggtattatttggcttatgtaataaagtaatgcttatggtattattatggtaactgtattaaggcagttacctatcaatgataatccttacctgaaccagtaattacattcgtgccatagaatacctataactcttatcatctcttcaacattattacatgaaactatttgtaaagtcatgctttccattgttaacttgcagataaccagatgcaacgtgaagatctagactggaccctggtttgatgaaccagctgtaaaaacacatttctggaacaactggagaaaccggagtatgccctggactggatattaaataaaaatttattgacatgtaaagatggcaattattaacaacaacaaaaaacagattataaaacatttcatacaacacgattgtattttggcaagcaaatacacacacacacacatactctcacacaggaaacgacctggaagaatatttggtgcttttattttttagattatttgtgtttctgaaatttctacaattaataaatactgctttaaaataatcaatggttatttgtaattttaaaaaatcaaggatttccattcaatgctagatgccacaagtgggtgacattctaagaaaaaatattggcgatatctacattgactagaaatttttatctagaacagactttttcaactgaagttcctcatctgaatctcaaaaaccagcaaatatggccaggcacggtggctcacgcctgaatcccagcactttgggaggccaaggcaggtggatcacttgaggtcaggagttcgagaccagcctggccaacatggcgaaactccatctctaccaaaaatatgataaaattagccaggcattgtagtgcacacatgtagtcccagctacccggaaagctgaggcaggagaatcacttgaaccccagagagggaggttgcagtgaggtaagatcgcgccactgcactccaccctgggcgacagagcaagactccacctcaaaaaaagaaaaacaaaaacaaaaacaaaaaaacagcaaataatttgagtgttttctgaactttgctgagaacagtaggtaaatagtcccatgctacaggcttagaggttaatttgttatgtatataatccatgccctagggaatgtataagacatacccatatgcagtagggcttaattatccctaggaactaaactaaaatatgcaaggatctcctgctaagcaacatgaaaaagaaaaaagcagaaaatctggtaaagaacatgaataagcaattcacaggaagggaaacaaaaaaacactagtgagtatatgaaaagatgctgaacctcattagtaatcagaggcatgcaaatgaaaatgagatcacgctacactcattggattggcaaaattagaaagctggatgatgccatgtcttgatgaggacatgcagaaatgtaatctcttatgcactgctcattatgaggataaagtattataaccattcgggagagcaattagatgatatttactaaaacgccgtttgcaggtgtcctgttatccagcaattctactcccagctacaatgacaggagactggcacagaatcagaagggagcatgtaccaggatgctcatggtgacacggtttgtaggggcaggaactggaaggcaatctaggtctccaacctcaggggaatgtatgaacaaaatatggtgaatgaacaccgcagatttctctgcagctgttagaagcaaagaactagatgtacttggagcagcatgaatagatcttgaaaaaaagtgctgaattaaaaaaacacaatgcaacagaaactgattcacagcttcaatgccatttatggacatttaaaatgcacacatatgcagaacaatgctttagcttttcgagcatatgtatcaaaacattaaaattggatgggtgcccctgggaaaaaggaaagtaggcaggggactgggaatgaagggaaagaaataaaactaaaagacaaaaggtttgcatagaccaatattgatgaagtgccacacactgaggagtgtgctgagctgcgtgaggtgcagagggaacctggaaaggagagagcaggagtatagaaaagtacagctcttgggaggctgaaggtcagatagtcaggtagcctggggtcaaatctgagctctgctgcttcccagctctttcaccttggacacgtcttccaagctccctcgcgtttctttttacgtcaaacaaggatacaagatgtatacacaagcagatagcagaattgctcctgacacacagtgggtacatgatgacattagtaaatttaaaactacaggccgggttttaaaactttagttttaacattagtaaatttaaaactacaggccggtggctcacgcctgtaatcccagcactttggggggccaaggcggatggatcacgtgaggtcaggagttcgacaccagcctaacaaacatggtgaaaccccgtctctactaaaaatacaaaaaagtagcaaagcgtggtagcaggcgcctgtaattctagctacttgggaggctgaggcaggagaattgcttgaacctgggaggcagaggttgcggtgagccaagatcacgccattgcactccagcctgggcgacagagagactctgtctcaaaacaaaacaaaaatgctacagagcaggaatgcacttccaagatctagtacaatgaatgtttctcaaatgcaagtggtaatttattaatgggtcatgaaataagtaatgggtcccaaacagcattaaaaagaaagattatcagagtacatttcactaaaagtatctttttatagaactgttatttcagttatatataatgagtactaaaatgcattttttccctatggcaggcaatcaaaaagtttgaaaaacatggatattgtccaaaggagttctacacctttgggcttcaagaaccagtaagtattccctgagacaaaagttgttcagggaggcaaccttttaatctataaagggcattcaaaaagaaacttttataatcttctcttactattgtaacataaaagaaaggacatttttaacattgtaaaaatagaacagaataacaggctttatgtaaaactcactactttgtacttatttttctcccttccctgtctttcggaacccgaggacagaatcccagaggtaggaatggactcactgaaggtcactgagtcagctgtgacagaggtgacacagaacccttatgtcctggcttcactttccaagctctgctcctcagaaccctaaggggtccacaaaagtggagcctagcaggtggggtctctagaatccccaaccctgttttactgggagtggccctgcttctgtgagatttcatttgaataaagaatttcactgtttaaaaaaaaaaaagaattagaaagctcctggggggcggaagccatgggagaatgctgcctcccaggatagggccagatcgcagaggttattatatttcaatttaaatttagatgtttttccctagtgacatgagggagctatttaggatttctaagcaagagagagaatagatcggggttgtgctgaaagataattactcaggtgcgagtgtaacagctggactggctgcataggaacagtgggaagtagagagcagctatttaaccattgcaaaggtcctggcatgaggctggggtgggggtgctgcctgaggcggcagggatgcagaagatggcacctcaaattctctggggttatggccagccaaagccaggctctccaagccataccccatatctccttttttctgctctaatacctgcttgggcagctctcccaggaacataggcatggggactccgaaggccctcacctgcagcgccagctggcagtcctcaatcaggccctgcaccaggtagtagcgtgcttcgcccagcagctcccccagttctctcgtactctccggcagtggcacagacccatcccgcaggtaattgaggattgtaccaaagtgacggccgctccggtcaatcagcacccaacctagtggggtggggagaggcagggggaaagatggctttgctgcgggacctggagctactaaattaaaaaaaaatttttgtagagatggagtctcactatgttgcccaggctggtcttgaactcctgggctcaagtgatcctcccatctcggcctcccaagtacttggattataggtgtgagccaccaaacctggcctaaattataagaaaaaaggattccagccaggcgcggtggctcatgcctataatcccagcaccttaggaggctgaggcaggcagatcacctgaggtcaggagtttgagactagcaggaccaacacggagaaaccccatctctactaaaaatacaaaattagctgggcttggtggctggtgccagctactcgggggggggcgaggcaggagaatcgcttgaagccgggaggtggagtttgcagtgagccgagatcgcgccattgcactccagcctgggtaataagagggaaactccgtctcaaaacaaaaaaataaaaaaagaaaagtaaagaaaagaaggccgggcacggtgactgacgcctgtaatcccagcactttgggaggccgaggtgggcggatcacctgaggtcaagagttcgagaccagcctgaccaacatggagaaatcccgtctttactaaaaacacaaaattagccgggcatggtggcgcatgcctgtaatcccagctactcaggaggctgaggcaggagaattgcttgaatccgggaggtgggggttgcggtgagccgagatcgtgccattgcactccagcctgggcaacaagagtgaaactccatctcaaaaaaaaagaaaagaaaagaaaagaaaagaaaaaggattccaaagccacaaaaaagtctgaatactgatctgtctcaaacctgtgccacagccaagaaatctctttaaaacatctccagcgagttctcccttaagtttttatacatattcaaccagataattaactcatccatatctggtctacagtcagaaggctctcaccatgagaaagttcttgcagaattaccttatcaataaactgttaacccccgaagttaattctcaccatcctatttaattaaaatgtctacctccccccgtccagttcactgccattttaacttttatattcttcatagagcttactatcaaaaaaagaaaaaagaaagaacttactactatctgcaattgcatatgcatatacattttgtttacttgcttattggtcttctgatctcccacttccctaaaaaaagggaatttccataattttgtcaggttcatttacctatctccagcactaactgatattttacaaatacttattggacaaatgaattcttcccttttttttttttttttttgagacagtctctctctgtcgcccaggctggagtgcagtggcgctgtctcggctcactgcaacctccgcctcccaggttcaagcgattctcctgtctcagcctcccgagtagctgggctacaggcgcacaccaccacgcccggctaatttttgtatttttagtagagacggggtttcgccatattggtcaggctggtctcgaactcctgacctcaggtgatccaccgcctcggcctcccaaagtgctgggattaaaggcgtgagccaccgcacctggccgaattcttcacctttgatacttgaaggcagatctccgcctctcaaatttttattctcctgctctcacagtcctcgttaacccctcccttaagactctcccactcccaaactccaaaacttcaaagtctcacttgggcacgaagggtccatacttgaatgcaacactccaagaaggtaaggttcacctgccaaggagacctgtccaccctccactctggtgtccctggcaaacccaaagcagcctccttctgcaatgtgtgtatacaggtggattcctagagtgtacagggacctgtgtcaggggaacacagaggcaaacaagatctcccagctctcctggctggctgtgagcagttctgaagcagagagggaaacaaaaggctgggcagtcggaagaaactgaggaaggctgccaggagtagtactgcaggcagcagggctagttcccaagtcttgagctgaggggtgaagggtgggagaggtggtcatgaggattatgaactgacacgttcaatcacttaccacagcgcctggcagttaggggttccgtaagtgttggttattgctgggggtaaaggattgggggaggagaagagaaattatgaatgagaaaggggaggagatgggatgtgggggctggagggagctgagaatgagttgactggacagtagcgggcagagagaaggggcatgaggagccccggtggtgagagactgcggggaacgggagttgggggtctggggtgggggcacggtaggggcgccgctcgtacctccggcatcggtcagcacctccacgcggccgctgaacatggctttgagcatggtgtcctgtcccgtgagggtgcgcagcgtggtgtagtgcaacgagccgcccacgttcagcttcacgtatttgctgttcggggtcagcggcttgagaccgtaggcggcggggccaggctcgagacccgagggcttgggggcttccagggacggggccgcggcggcagccgggcccgaggcctccgccgacatgccgggtagcagcggcggacggcgatcccaggatctctccgcgccctgcggcctgctcccgaagaccctcggccggcccccagcccttgggccagaccgctcggcgcacacgcccactcaccgcagctactctgcaagaccggccctccgccccatctcgctcgcaccacccggaagccggcgccgggcag

SEQ ID NO: 69 - DNA, 11023 bp, Homo sapiens
gaggaggagggtcggggacggaagcgcagagcacggaccccgccccctcgcggccccgctcgtgacgtcgcggggggcgccggcctccgcccggccccgaggggtaagagcgagcggctggcggatccgacgcgcgagaccgggaggggacgagggcgttgcaatcgttcggggcgggggctttccggggagggggtgctcaggtgcaccagcggcggcggaccctcagactctgccctcccctccctttaacccccttccagccggacgggaggcggggcagggctgagcatttgtgacacctacatttccgtggctcccttcttttcccccgacccctgtttatctcttcgccttccagaagttcttttccatcaggccgtcgcaccttgcgtgggaaggagcaccccacttggaagcaggaggcggggttcagatcttggccctacccctcctgtgttaaagtccgcgagcctcagtttccctcacagtattttttgcctcgccttacccggttttgaggatctgtacgagaaagagaaaggaagtggacatttgttgaattcctgcatggccaaataccacgcagactgcttcatccgccacgtttaatccttattacttggtgttctcagaactcccatttcatggattcttaagctcacagagtcagtgaataacagaaagggattcagatctagccgtttagctgcacagtggagttcttctccagagtcttcccttgtctgggctctggctggaactattcctcagccaaatcctcgccccagaacagtgcttcctgtttctccagctgagaagtctccctttcagtttccttcttccagcacggagtacactgctctgcctccacttagattacttcagaaatgaaatgcagcaaatatttatccagcagtgcagggagttgaacttttggagtcgggaaccttggattcttgttctggctctgccacttactgtgtggccttgggaagtcctttgtcttctctgagctttcttttctctttgcgtaaaagcggtgctcttgtcccattctccctccctgtcttccagcaggctctccccggaggctcagccccctctgctccccatgggcaactgccaggcagggcacaacctgcacctgtgtctggcccaccacccacctctggtctgtgccactttgatcctgctgctccttggcctctctggcctgggccttggcagcttcctcctcacccacaggactggcctgcgcagccctgacatcccccaggtaagttccccacccccgtacccgctcttccttccaacctagacaggcttttgctgctaatctcatctcacccgtcttcttttgctcacaggactgggtctcttttttgagatcttttggccagctgaccctgtgtcccaggaatgggacagtcacagggaagtggcgagggtctcacgtcgtgggcttgctgaccaccttgaacttcggagacggtccagacaggaacaagacccggacattccaggccacagtcctgggaagtcagatgggattgaaaggtgagatcagaggctgggtgtggtggctcacgcctgtaatcccaacactttgggaggctaaggtaggtggatcatttgaggtcaggagttcaagaccagcctggccaacatgatgaaacaccatctctactaaaaatacaaaaattagccaggcatggtggcaggcgcctctaatcccaactactcgggaggctgaggaaggagaatcgcttgaacccaggagatggaggttgcagtgaaccgagatcgcaccattgcactccagcctgggtgacagagcaagactctgtctcaaaaaaaaaaaaaaaaaaaatcaggtgcggtggctcatgcctgtaatcccagcactttgggagtccgagaagggcagatcacgaggttaggagttcgagaccagcctggccaacatggtgaaaccccgtctctactagaaatacaaaaattaacctggtggtctggttgcggtggcccacagcggtaatcccagcagtttgggaggccgaggcgggcagatcatgaggtcaggagtttgagtccagcctgaccaacatggtgaaaccccatctctactaaaaatacaaaaattagccgggcatggttgcacgtgcctgtaatcccagctactcaggaggctgaggcaggagaatcacttgaagccaggaggcggaggttgcagtgagccgagatcgtaccactgcactccatcctgggcaacagagcaaaactcggtctcaaaaaaaaaaattagccaggcttggtggtgcaagcctgtagttccagctacttgggaggctgaggcaggagaattgcttgaacccgggaggtggaggttgcagtgagccaagatcgtgccactgtactccagcctgggagacagagcaagactccgtctcaaacaaacaaacaaacaaaaatacaaaaagtagccaggtgtggtggcaggtgcctgtagtcccagctacttgggaggctgaggcaggagaatcgcttgaacctgggaggcggaggttgcaataagcagagatcacaccactgcactctagcctgggcaacagagactctgtcccgccccgcgccccccccaccaccctgcgccaaaaaaaaaaaagtaaggtgagatcacagaggactgtggggtcgggtatcagaacactcagggctgggccctgcctctgacctcaccaatgatgaccttgggcacatccctggactttagtcacttctgtgattagggctttcagtgaacatgctgccgacagggtaggttttctatgaatgctttcttcctctgccagttctgatgttctttgagtctatccttggaggtaggatgaaatgggctaggtttgacctaatgttttctcatcctttagccacctcctcctagaggcccctttttccttagcatagttctgtatgccacaaaagatgcagaaaaaaattagacaccatcaatttccaaagagctatagtcttctgggaaaatgacaagcgatagggagaatgtgaaaatgtcagtggatgccaataatccctgtgtgacatttggccttatctaaaatatgctaagataaagagggatggaagagggtggtattttctgacttctgaggtcctttacaacactatcattctaagattctcctgtgagtatatatgtgtcgggggagtgggtctctgcatgtccagatgtacatgtatgttaacaaaaataaggaatgtgtccgatatatgcagacttgggacaattctttcccattctttttacttttaaatagatatataatagttttattgagatatgattcatgtaccatacaattcacccattgaaagtgtacagttagggccggatgtggtggctcatgcctgtaatcccagcactttgggaggccaaggcaggcagattgcttgagcgcaggtgttcgagaccagcctggacaaaatggcaagactctgtctctactaaaaatacaaaaaaaaaaaaaaaaaaaagccaggcgtggtggtgcacacctgtggtcccagctacttgggaggctaaggtgggaggattgcttatccctgggaggcagggcttgcagtaaacattctcctgcctcagcctcctgagtagctgggattacaggtgctcgccatcacgctcacctaattcccgccccccagcccaaggagtcttgctctgtcacccagactggagggcagtgatgcgatctcagctcactgaacctctgcctcccagtttcaggagattctcctgcctcagtctcccaagtagctgggattacaggcatgtggcaccatgcccagctaatttttgtatttttagtagagatggggtttcaccatgttggccaggctggtcttgaactcctgacctcatgatccgcccgccttggcctcccaaagtgctgggattacaggtgtgagccactgcgcctggccaatttttgtattttttatagagatgtggtctcactatgttgcccaggctagtttcaaactactgggctcaagtgatcctcctgcctcacctcccaaagtgctgggattacaggcatgagctaccgggtctggcgtattacccaattgttttatttactttctcttgattgctagtaaggttgagcctcttatggtttattgtctgtattcatgttgcctgtgaattacctgtttgtttcctttgttcctttttcttttaagttatttgtctttttcttcttgatttgtaggtctttattctagatagtaaaccttttgtcatttaaatatattataggtattttcaatatgttacttgtttttttaacttatctttcattgcatagaagtctttaatttttatgaggttaggtttatcactcttgtcctttattaaaacttttaggttttgtgtctttcataggaagcccttcctcattttaaaattagaaaatattctggccaggcgtggtggctcattcctataatcccagcctttggaaggctgaggcaggtggatcacctgaggtcaggagttcaagactggcctggccaacatgatgaaaccccgtctctactaaaaatacaaaaaattagccaggcatggtcgtgggcacctgtaatcccagctactcacaaggctgaggcaggagaattgcttaaacctaggaggtggaggttgcagtgagctgagattgcaccactgcactccagcctgggcaacaagagtgaaactctgtctcaaaaataataaaataaaataaaataaaataaaatattctgtattttctttaaatacttaagtttttttttagtttgtatagttctttaatacatctgaactttattttataagataacagtttgacgctatgtttttttctacatggaaattttcccaaggccatttactgaggccatcctttccccactaatttaaaatagggtgagaaccttttaatggattttggtaccaagtgagaaactgctttcttaaaaagaatgaactagtttatgcaaactgacatgggcaatgtgtatctgcccatttcactgcagccttgcgagtattagtatggttgttgtattgattgtaatttaagttaatttaaattacaacttaatttgtgtttatattgatacaaagttattttcatttctcagtgatataaataatggtatatggaatactttattgaatagaatcaatgccaaaacacctggtattatagaaagccttaaaaaatgactaggggcaggcgtggtggttcatgcctggaatcccaacattttgggaggtcagggtagcaggatggcttgagcccaggagtttgagtccagcccgggcaatacagtgataccctgtctctacaaaaaaatttttttaaattagccaggtaggtggcacacacttgtagccctgcctactcaggagactgaggtgggaggatcacttgagcctaggaggttgaggctcccgtgagctgggatcgtgccactgcactccaacctgcacgacaaagtgagaccccatctcaaaaaaataaagaaagaaagaaaatacaagaaaagggccgggcacggtggctcacgcctgtaatcccagcactttgggaggccaaggcgggcggatcacgaggtcaggagatcaagaccatcctggctaccacagtgaaaccccgtctctactaaaaatacaaaaaattagctgggcctggtggtgggcacctgtagtcccagctactcgggagactgaggcaggagaatggtgtgaacccgggaggcggagcttgcagtgagccgagattgcgccactgcactccagcctgggtgatagagcgagactccgcctcaaaaaaaaaaaaagaaaatacaagaaaagaagcgtgaagacagaggctcccgcgtcacctctcattttcttccattttctcttctgtgcctttcacaggatcttctgcaggacaactggtccttatcacagccagggtgaccacagaaaggactgcaggaacctgcctatattttagtgctgttccaggaatcctaccctccagccagccacccatatcctgctcagaggagggggctggaaatgccaccctgagccctagaatgggtgaggaatgtgttagtgtctggagccatgaaggccttgtgctgaccaagctgctcacctcggtaagagcctcagatgggtcgccagggttttgtagactgcctgctgactactgtatcttgaaggtccctggaaacaattctaccttgtagaaaaagcacaggttttataaccctgccttgggggctgtgtgacgtagaacaagtgtctaaacatctctgagtgtcagcatcctcatctgtaaaacagaaaacatgaccctatctcttaattccatcaaataaggattaaatgagaatgaccgtgaagtgcccagcacattgcctgggacatagagatttgataagtgacagctattgttgtttactattgtctttaaaacattctctctacttcaaaggagttcagaagctataataagaggcaaatgggctaattgctattagagagatgtgagcaaagtgttatgcaaacacagagaaaggagccattaaccctaacttgaacatttatggagagtgcatcacagagaaggtggcatttaccagagagcattgtgcacagtggtttataatgcacaaagtgctctcagggttcattaattcatttgatcttaaaatagccttttgaggtaggtgttattatcccattttacagatgaggaaacaggtttagagaaagggagtgaattgctgcaggccacacaactggttaagtggcagagccagggttgcaacccacaccttctgtcaagtcagaatgatccttgaagaatgaggaagatttggacagggactgcagtagaggaggttcaggagagggggaggtacactccaggcaaaggcaccagcatgcgcacaggcctagagattgaaaagtgttcagccaggtgtcacatctgtaatcccagcactttggaaggccgaagcaaggagaatgcctgaggccaggagttccagaccagcctggagaacatagcaagacctcgtttctttttcgcttttttttttttttttttttttgagacggagtctcactctgttacccaggctggggtgcagtggcacaatctcggctcactgcaagctccacctcacaggttcatgccattctcctgcctcaggctcccgagtagctgggactacaggcgcctgccaccatgcccggctaatttttgtatttttagtagagacagggtttcaccttgttagccaggatgatctcaatctcctgacctcgtgatccacccacctcagcctcccaaagtgctgggattacaggtgtgagccactgcgcctggcgaccccatttcttaaaaaaaacatttttttttttaattagcagggtgtggtggtacacacctatagtcccagctactcaggaggctgaggtgggaggatcctttgatcccaggagtttgaggctgcagtgagccatgattgtgccactgcactccagcctggttgccagagtgagaccctgtctcaagaaggaaaaaaaaagaaagtgttcagcctttgggagcactccatgttgagaggcttaggaaggagaaaaggcaagagagaccacagggatttgatggagaggctctgtgaatgcaggatagagggctatgacctgatgctgaaggccgtgggggccactgaggagttttaaggaggagagagatgtgcttccctggtgctgggtggagaatggctgagtggaggagggccatcagtcaggaggctgctgcacactccactctcacatttgaaaataccccatgaggcacggtggctcacgcctgtaatcccagcactttgggaggccaaggccggtggatcacttgaggtcaggaccagcctggccaacatggtgaaaccccatctctactaaaaatttaaaaattagctggatgttgtggcgggcgtctgtgatcccagctactcaggaggctgaggcaggagaatctctggaacctgggaggcagaggttgtagtgagctgagatcatgccactgcactccagcctgggcaacagagtgagactccgtctcaaataaagaaaaaaagaaaagaccccatgaggagcacaacctgggacttggaatcagagatctggtttccagatctagcactgcttgcactttttttttttttttttttgagatggagtcttgctctatcgcccaggcgggagtgcagtggcgcaatctcagcttactgcaagctccgcctcccaggttcacgccattctcctgcctcagcctcccaagtagctgggactacaggcgcccgccaccatgcccggctaagtttttgtatttttagtagagatggggtttcactgtgttagccaggatggtctcaatctcctgacctcgtgatccacccacctcggcctctcaaagtgctgggattacaggtgtgagccaccgcacccagccacttatacatctttaaactgtggatcataatgaagtttcctatctcatggagttatgatggggtttcaggttgataattgggcaagaaagtagtttttaaaccatcaagacaaatgttcgagcctgggcaacatggtgaaaccccatctctacaaaaaaacacacaaaaaattagctgggcgtggtggcacacacctgtggtcccagctactcaggaggctgaggtgggaagatcgctggagcccaggaggcggaggttgcagtgagccgagattgcactactgcactccagcctgagttacagagtgagaccctgcctcaaaaagaaaaaaaaaaaaaagggccaggcgcggtgtttcacgcctgtaatcccagcactttgggaggccgaggtgggcggatcatgaggtcaggagatcaagaccatcctggctaacacggtgaaaccccgtctctactaaaaatacaaaaaatgagccaggcgtggtggcgggcacctgtagtcccagctacttgggaggctgaggcaggagaatggcgtgaacccaggaggcggagcttgcagtgagctgagatcgcgccactgcactctagcctgggcgacagagcaagactccatctcaaaaaaaaaaaaaaaagacaaatgtcagcttatatgaaaataacattttcccttcagttgctccctagatgtggagagccctctccctcatggaggctccttctatagcccttggactggattaacatgtcctcctcctcctctccctgtacccctccctaggaggagctggctctgtgtggctccaggctgctggtcttgggctccttcctgcttctcttctgtggccttctctgctgtgtcactgctatgtgcttccacccgcgccgggagtcccactggtctagaacccggctctgagggcactggcctagttcccgacttgtttctcaggtgaggttctttgctccagtcctgcgggagcagggaatggggtgggggtgggggttgtaaccggggtagagcagatccttggacttttcctcaaagactgctgcttctgagtccccgagaacctcttcaaccacagctctcccttagggactgggaacaatttgacaccgtcagcattcaatatttttctaattactttaacttttttattataaaatagttaacacttatgtagaaaagtccaatagtataaaaggacagcttggcaaattattataaagtggatacttataaataccactgagtagaatattaccagctgtccagaaaccccccatggtcccttccttcctgacaatgccctctctctccctagaaattactgtcctgctttataatgtattgccatgtatgtattcctaaataatatagtttggttttacttatttttgaaactatgtagacagaatcatacacattcttttgtggctgacttctttcaagcaacattgtgattttaagactcataactagttcacatccaagcatttgggtaacaatggtgagttaagagggttcacatttgatgatttgtcctgaatatgaaccatgtttgtcttgcttttgtcctgaaattccaatacccagttttatgatggaaattttgtaaaattcaacttgaaccgctcagaagagtctaactgatgatactcatttactggggacatagtatgtgcccaagaacttgacatgcaccttctgtcttccatttagtcatcgttacctttagaaaaagctgattccgttaacaagatctttggagggaatcagcttcacaaacgtagcagtgggtgggggtcatgttggttaaccagttcacacatcagctcactaaaggaaaaaatatttctgcaaaaaatcttcacttgtcagaggggggtgcatgaaatttgagagccatgtgttatgcatccagctcttgaactggtctcagcttcagctggctgcagtgccctaggaagttactatgggaaaagtggaaatagttgaggcccagggaactgatcaggccagaggaagtggaagctcaagatcaactgtgcttattttgctgatggctgggcctaaatgccccaaccacctacttgggacaggaaatgacaggaccctctcaaccttggactgggaaaggagggcttcctggcccctgacagaccctggggtcctgaggctaccttagttgggattaaatgcccgtattggtctctagctgtcactccctctgctccttcctcaatttctgcacacatctcagagcttcctctagcagctcttcgacctgttttgttgttttattttctttctccccaggtgtgaatcaacttcttgggccttggctctgagttggaaaaggttttagaaaaagtgaagagctggaatgtgggggaaaataaaaagcttttttgcccagtgg

SEQ ID NO: 70 - DNA, 3072 bp, Homo sapiens
tgaggtgattaaaaacactcctttattgagtcttaaaaaataaacaccttaaagggacagcgtgaagctgagaagtagcatcccaacagcttgtgtccttgggagctgcagtcttctctgaaggaagctgcttctgttccacagacacagggcaaggggtgctatgtatgctttgtacatgtatcaagggtccctcctgggggtggcagagctcagttactctcgccatcactgctgatgatgccacgcatatgtgaccagtctgggggtgcgggacggggccgctcttcatctgagtccagggtccgtcggtacagctcccctgggggtgctgcttctcctaaagggttccaggctgtacgtctgcgtggccggcctaggggaaaggggaaacgagagatcagatgtctgagaaggtccaaccccacctatctgctcctgggcagtgagaggaaaccccttacccgagccactgatgatgttcgcaacatccaaggaggccacctcagctgcctcctccctctgctccttcagggcccgacacttccctagggaaggggtacctggggcagaagaagctggtgattctctcctccccagcaggaaggccctctcctgcagcccccagggcacgccgggcctcacccttcatgcctagcgcttccagttctgcccggaggatactcaggcgctccttgtgtgagcaacaggagcccaacagcttcttgtagtttcgatgggcaccacaggcccgaatgtagcgcttcagcctcatcacagccgggtggtcctctccacggcgacctgagccagcctagcaaggaaagagcagctgaaggccaagcctgctgggcctgaggcagggtctccctcttccctaatagtggcctcccacccctcctcaccctcaccttccctcctttggcctctggacttccatctgaggaggaagaggagcttcgtgtcctgcctttcctggagctcttcttggaagagcggttcttcctctccccctgggggcctccccctgcctcgctgtcacttacctccctctccaagtcactttcctcaccactggtgctgcccagtctggccatctttctagagcctttagctgtgggttcccccttcccactgtcttcctcgtcctcgctgcttccactcaacctcttcccacccttaagctgggtcctgtcctcactcttcctctgcactgggggttctctatctctcccactgtcatccccactgctggctgcctctttctgctcttcctcgctgtctgagtctcccaagagcctctttgcctggcttttctgcttacagctcctctcctccctagctgactttctccggccattgctcctggttctgggtttccaatcccccttttcctcatcctcttctttctcttcctcctccacttcctcctctctctgctctttcttctgggctaggatctcctcttcactctcctgttcactttccttcaggcttttagttcctttatttccctccaccttctttgctgtcctctgaacgggttctgcctcgctctcctcactttcttccctggcctgcttcctactgactgaggccttgcctggtgcctgcttctttaccacaggtttcttcctagtcttccccttgtaccccttttcctcctcctcactgctctcctctcccctctgtgcgggcaggtccctctgccgttcctcatcactgctctcctcaactgcctttgaggctcgccttggattctcctctttggctgggctgacttctgctgccaccccattctttgctgggggtccaaagtagtctgggctggaggcttcagagccggactctggaatatggagaggagagagggttgagacaggctcctcctgtcccttctcccttcacttcggataggttgcctcgagccctgccctgacagttggaggggcagcaggaaacagctatctgtacttgctgttcccggttcctgactcactagccttgctccctcatctaacgcctggggacataagagatgcgcagtgaatgcttcttgagtgaaccaacgatgcagaaggcccccacagcagggaggaagcactaacccgactctgaattgaagcggaacctttttctctccgggtcgctacaaggggtgggaggcctcttgcccttcttggtaaggtccagtttgtcttccctggaagcggcttcatccacctgtgtgtgcgccaagagggcaaactatgcaccaaggctgcgctcaccgcgccccgtcaggcccctcctcctcagcagcaagccccgcctccgcctcccgcggcccaggctccggcccggcacacctgcatcttcagcagctcctcctccaccagccgcttcagtgcctgcttctcctcgggctccaggtggctgcggcccgagtgagctaagtacctccgccgcacgatggaatgcgtaagcgtgctgcagggacatggtgtcaggacggagtcccgacccacccgcgccctttccaaccccatctccaaccccctgggcacctgaggtccgggcggcctcggaagaagctacgggtgaactcctgcatctccttctcccgcgccattttgctcaacccgggattgacggctcccgcctttttttcttctcggcctccgtcagcgcgtttgacagcggctcgcgcacgcgcagtgctgcggcaacgtggggcgagggaccgttggcccttggccgcggaccgcgtgggccgagaactttgccagacgagacttgttttctctgggcagttggagggtctcgcggctcctacccttttttggaacggatcattttaaaagttctcgttagaaaccaattcggcgccggcaccctttgggtgaaacctaatcagcccgcgacgctgcctttctcactggtcacgggcaacagctaggctgctgttatttcgcaaggcagaagagaaaaggcatcctcgcgagcagatgaggaacctcggggataaatccttttgtggcttcaagtgtctaagtacattagagtcaggaacggcgctttccagcgtccgcc

SEQ ID NO: 71 - DNA, 9582 bp, Homo sapiens
acagccttgcagcgtctccggaagtggaggcgggagcggcacggcagccactgcttggggtagcgggagggcagactctgggcgccactcccgggccggtcatgaacgggccggcggacggcgaagtggactacaaaaaaaaataccggaatctgaagcggaagctcaagttcctcatctacgtgagtgctgccgcgggaaggctgtgggggatgaggcctggcgcggacaagatctcagtttacccaggtgtaaagtgggtggggcgagcggccgctggttccggggcccttcacggaggaccgttggcccagcgcaccccttgcccgtgatacaggagcacgagtgcttccaggaggagctgaggaaagcgcaaaggaaattactgaaggtgtcccgggacaagaggtgaggcacgttgcaggggcggagggcgatgtgcttcctaggaaatctacattcggaccccatccccgagtagggccacaagtgcatgggctctttcaagtatccgatgggccagctgggagggacaggtacccaggaggacattgctgcgctggaaaatcactgtccgtgtctccttccctcccctcagtttcctcctagaccgacttctgcagtacgagaacgtggatgaagactcttcgggtgagcaaggtcttcaaaaattggtggagagcatggttcctggtacttagcaagcttcctgggcccccgccttttaggcagtggtggctgatgcagcccccagtggtccttaagcctagttgcttgccttccacctccaccgttctttcattcaggcacttactgagcacctattgtgtttcaggcactgtgcttggcacaggggatacagcagaggcagagataggcaaagcccttggcctcttgtaatttatattctagttgggaagaataagtaaatgaagacaatagactagaattttaggtcataggaaggacttgaaggtaatgaaaacagttatgcggtaatgattatagtagaacaggggttgatgaattgtttctgcaaagggccagatggtaagtaagctttttgcaacatacaatctttgaagcacctactgaactctgccattgtagtagcagccgtaccccataggcaaatacatgagtatggctatgtttctataaaactttataggcactgaaatttgaatttcatatttttccatatgaaaaatttttctttagttttttttttttccaaccgtttaaaagcttaaaagccattcttggccaggtgcagtggcccacgcctgtaatcccaacactttgggaggccgaggtgggcggatcacaaggtcgggagttcaagaccagcctgaccaacatggtgaaacctcgtctctactaaagatacaaaaattagtcgggtgtggtggcgtgcacctgtaatcccagctactggggaggctgaggcaggagaatcatttgaaccctggaggcagaggttgcagtgagccgagatcgctgccactgcattccagcctgggtgacagggcgagactccgtctcaaaaaaaaaaaaaaacgcccttcttagcttgcagaccacacaagcaggcagcaggcaacctctgaatggagtactcaagaaaggcctttcacagagtgacatttgagttgggaccagagaagaaaccagccttccatcctgggcaacatagtgagaccccatctcaattaaaaaaaaattagccatgtatagtggtgtatacatgtggtcccagctacttgggaggcagaaccaggaggatcccttgcctgaaaggtcaaggctgcagtgagccatgatagcaccgctgtgctccagcctgggtgacagagcaagactgtctcaaaagaaagaaaccccatcctggctaacacagtgaaaccctgtctctactaaaaatacaaaaagttagccggggatgttggtgggcacctgtagtcccagttactcgggaggctgaggcagaagaatggcgtgaacctgggaggtggagcttgcagtgagctgagattgcactactgcagtccagcctgggcaacagagccagactccatctcaaaaaaaaaaaaaaaacaaaaaccaatcttgtgaagaagtgggctagagctgtcccggcagaataatataaatgcagctaccctgaggtaagaacaggtcaggcttggttgaagagcagaggcatgaaagagagagaacactgttttcgtccttttatttgaatattgtctgcagttaactatattttacatcataaccagggccccacatgttaaacaaaacaaagtttaacgaaacatttttaagatcactgtatccaattcatcctgacactttttagactgcttttttccccttcttttaatgctggttgcaaaccaataaattgatttcatgacccactaatggcttgagacccacagtttgaaaaagccctaaggtaggcatttgtgggcctcttcctgggtgaggccctcgtaagccatgtcacgtagaatcacctctctccgtggtgcctttaaacattggtctgggccgggcacggtggctcacgcttgtaatcccagcactttgggaggccgaggcaggcagatcacgaggtcaggagatcgagaccgtcctggctaacatggtgaaaccccgtctctactaaaaatacataaaattagctgggtgtggtggcgggcgcctgtagtcccagctactcaggaggctgaggcagaagaatggtgtgaacccgggaggcggagcttgcagtgagccgagattacgccactgcactccagcctgggcaacagagcaagactccgtctcaaaaaaaaaaaaaagcacattggtctgaggcagggattggcatgtggcagccagccacgttttaggacgtagtgttttgtcagaacgcatgatacccatttgcttgttattataggaggattgtagataaggttggggaaataggcaggggcccactcaggtaggtcatagtaggagatttggcttttattgtagcctctcatcccctgcctcttccttccctaggggcttccagttaacatcctgtttgaggggaattcagggcaggaggtgggagagaacccagcatgttcatggccagagtgggttgcatctgaggaggaagagccagcgatgcgagccccactcccgtcctggaggcccacgccctggccagggagacactcgcaaacgacgcttttcagcacagtgtgagggcagccatgacgagagtagagcgttccaggagagcctgcagttaactgggcttgagggattctggaagacttcacagaggaggtggcatttaatctgcttcttaaagggtctgtctgagcagagacattggtaacggcttctataggtgtagcagtcgtttgttcgatgaaagatggcccttctaggcagaggcactgaactaggaaatacatttcttttttgacgaaataggtcagtgtgctttaaagaatacagttacgttagttgaccagaaaggtacattgaagccagattaagcagcaccatgaattcatgcaggtagtgggtgatgtcatcaggaaggatgtgaccaggtttgttttaggtcactctggggttgggggtggacagtgggtggcacggtgaggtgagactgcttagcaggtgattttgacgtgctggtggcctgacctgtgttagttggtgtggggagcagtggatgaaggggaggacttcaggggtagatgaacaggaccctggttatggggagtggggcagaggcaggagttgaagactgctcagctcagaggcaaggaaccagtggcatcaaacagccaaggagtcacagacctggcttggagtcttagcctcacaccttactttctgagcctcggtgacctcatgtgacaagtggaggtgctgcccttcccatccttccttggatctgatgacaaggagaggtggtgagtgggaaagagcctggcaccctggccatgcgtggcaggtgtgttacggaggaaccagagcgggcggggggctggggaggctggagaggctatgggcctccctgggacagctcgagtgtgtggtgcatgcgtgtgcccaccagctggtgagtcagattcccccggggcccttctgttaggttttggtttgtttcatttttttgaggcagggtcttgctctgtcacccaggctggcgtgcagtgttaaaatcacagctcactgcagtctcaatctccgagtagttctcctgcctcagcctcctgagtagctgggactacaagcacacgccaccatgctcggataattgtttttgtttttaatagagatgaggtcttgctaggttgtccaggctgctcttgaactcctggcctcaagcgatctggccacctcagcctctcacagtgctgggattccaggcgtgagcccccgcacctggtcttccagtgcccttctgtagtgtagaggaggttatacctttctgggatggactgggatccccccatccccactgaccagctgtccccatcacagactcagatgccactgcatcatcagataacagcgagacggaggggacacccaagttgtctgacacaccggcccctaagaggtgagaagaagatgcattcctctcgctggggagggtcaggtggggcgcctgggctcctagccacatctgacctcgccctgtcctttctccaggaagagaagccctccgctggggggcgccccctctccctccagcctctccctgcctccttcaacagggtttccccttcaggcctccggggtcccctccccatacctgagctcggtgagttggggtcagggatgggaagtgcttgggagtaaggtgggcgtcatttgggcagaagggctgggcctcggggcaaggccagcccaactttggggacatctgtctgggtgtggcccaagtgtcccgtggagggtgtgagtcggggctgcccccttctctctggtataggaacggggccaggcctgactgaggagagcaaagcccaggacagcatcctgctgctgcccggcccttctgtgctcgggagccccgggagccgcactcatcaccatctcttttgtttttccatcctccttctgtttgcatttcttcccccaccctcaccccggtccattccgcctcccatctccatccccgctcccgcccgcagctggcctcctcccgctaccccccattcccttctgactacctggccctgcagctgcccgagcccagtcccctgaggcccaagcgggagaaacggccccgcctgccccggaaactcaaggtaccctgacgtgggggtgctagggaggggcaggacggcaggaggacagtcacctgagggaggctgaaggcgggggcctgtcagagaaccatgaacagttaatttggggacccagtcagcacttagcactgaggggtggatcacagaagtctcggcttacaggcttgtatggagacaaatcagggcagaaccagccttggaggacccggtgtgcagatgccagggatcccgccctttcatggctgcagtgtagcggggccaggctcattttcccaggggggcgtgttgtgtgatgccaggtagccccagaccgggtcaggattatgggatctagagtcaagtcaagactgcctgttagaaaccacgtggccttgagcaggtctctgctaccctctaggcctcctaggcttggcacctatagggcgagtggtcctactcgatgtgaccagcaagcgcccctggagcgcctcctgttacacggcagtgcacaaagcagaccagtgcctgccctcacagagctcacagtctagcaagataggcagaaaacacaccagaaaagtaggtacttgtggagaagaacagagcgaggtccagagcatggggacgccagggggacgaggctgacacttagggcccagcagtctgggatgttcttgatcagagacttacaggaaatggcagcaagctgtgtggctcctgggcagtgtttctgtcgggcagagtctgtgtttgggagaaaagtaagcagggaattgggtcccggagcaggtcagagggggagctcatgaggtgccagtgtgcaggattcgctgtgaatgaagccttggagacagcagttccctggcggggcgcaggttgcaggtgtggagggggagtgatctaattgcatcttaacaaaattgcagacactggtggtcagagaacagactgagcggtggagtgagttgggacgggagtgaggaggccaccacggtaaaccaggccaagggcagagggtccagagggagctgcggacccatttcagagaatgagcatgggagttcctggaggacctggtgtgggctgtgcgggagagaggccaggatgcctccagggctttagtctgagcacgagtggagtctccctccctggagatgggagggctgtgggaccacaggcttggaggaaaactgagtctggccgcggatgtgtcagatgccatctggaaaggcagctagatagcggcccgtgaggggctgcgcatttggaagccgccaggctggcggtagatgcaagccttgggagagatggggatgggctgaggggcagagcggagtggggaccaactgggcggctcccagggttctggagccagaagcagaatgagaggccgcatttgcggtggtctggagtacaggatctggagctctaatcccaactctgccgttttctccgtgtgaccttggccctgtgaggcttcacctcttgagcctgagaagcagaggtgacagtactggccctggttcttagcaggggggtggcgggcagggtagggggtggcgcagcactggggggcactttgaggctttctggctgggtgctgagtcctgaagcagagtcatgtccgggagcaaagttgtagacattctggagagaaggtttgagagggtggcccaggtccatggctgtcgggggaggtggggagaagccaggaaaggcctcagcaaggagaacgtgtaagcccagggtgagtggatttggatattcctggctgaagccatagtgggaagggagacagggccacagggaaagcactgcctgggccagagcaggagtggtaagaaattggcaagaagaaccgggtggggtggggtcatggaaggcctggacagtggcctgaagtgggaatttgtctgttactgtcaggggagcgggagtccctgaagggccaggggagtgaggagatggaaggaagggagtccaagcagaggaaggatagctgtgaagacagaagcaggttggttctgtcaggcctgagttggacttggccagctttgaatcccagctcttccagtgctcaccatgcgacctcagcgttgtcatttcactctttaagccacagctctctttctccattcagtggcggcattgtgcggagaatgtgagtgaagggatgaaaatcgctcggcccgtgcctggcccctagtaagccacagagaaatgtgagccgctgccagtcaggctgagaggacgccactgaggaagtccaggccagggtgggacatgctgcgcacagtggggaaggagaggaggtggccagaggaggggatggtcctttccagtcatacacgcatgtctgcttgtgtgtgtacatgtgggggcctggtgcagggcgtgggggtgctgttcagagttggaccccccatcatccatcctgccagcctcctataccctgaggcctgacccaccctggcccccacaccaccccagcagcggagatgagggtaagtgagggctccttaggaagcagagaggaggccacagggccaaatgtgacactcagaagggccactggagaccacgcatggcgtttcctgccagcccactcagcatctagcccagggccagactggacactgccccgcaggacccagcaggcctaagcctcaggacctccatgtccacaccaggttcagcctcctctgctggcacgtgacttctccccgtttcccgccccccagtgtcctgaggctgggagggcattaacagaaaccacctgacacacagcaggtgcccagtttgtgcccacagacaaagcacggggactgcagaggagacccacagagctctctagggagggtttgtgaggacctggcagcgggggggagctgaagggttgagcagggcagaggccacttcccaccctcagaggacaaagcaggacttctgacaaatagagcaggatgcccagggggaggggctgcctgtcgtcccgcaggcggcactcccgccccgaggccccgagtggcacggtgacgcgctcaggtctgtgttttagagcgcgcgctctggctgccgtgcggaggagctggatctgggagaggctgcgggcagggagtccagttaggaggctgggaccgcagcccaggtgagctaagaggagggctgggcctaggccacagctgccgggaccccgaggaggggcccatccaagacataatacaagcttcttgggggcagataagccgctggggctcctggctcaggcagcctgcaataccctccaccgaaccagtgagtgccgcagaagagggagaggaggagtagggagaggaagctggtggcaggtggcacctccggggccggcaggcaggcaagcactccaggccgactccgcctctggcttaacccctgtctcagggcagcccaggcgcctccctggagagggcaggtgcccgggcctttccctcccggtttcctgtgagacacccccatcccctcatctcacctctatcaccacccccaggcacttgctggtttgaggctctcgaggggctgaggggggcaggccctgagtgcagcatgggttggcccagctgtgcccagggcctcttccccctccccagagctgccctggggggcaaagcctagtctcctgaggccccagtgcctccctgactagtccccctgtgtttcttccccctgctgcagatggcggtgggaccccccgactgccctgtgggagggccgctgaccttccctggccggggttctggggctggggtcgggacaaccctgacccccctcccaccccctaagatgcccccccccacgatcctgagcacggtccctcggcagatgttcagcgatgcaggtagcggggacgatgccttggatggagacgatgacctggtgatcgacatcccggagtgaccgtgacatcacgccatgcccaccacggccccgcccggcgccctccccgtgccagcacacacgagtccagcttcctcggaggtgtttattgatgcccagctgccatgctccggccactgacacaaccagaaaaggcgtaaacatgcacgggtgtcccccaggagggtggcaggggccctgccttcaaaccccggccccctccaggggacagttatttaaacgagtggccgggagcatctgccacctgctggggaggcagagaccctgcaatggccacctctttaaaagggcagctgtacagggctaggttttttcaatgaagtttctgtattaaaggagtggctctggg

SEQ ID NO: 72 - DNA, 5567 bp, Homo sapiens
ttcctcggaggtgtttattgatgcccagctgccatgctccggccactgacacaaccagaaaaggcgtaaacatgcacgggtgtcccccaggagggtggcaggggccctgccttcaaaccccggccccctccaggggacagttatttaaacgagtggccgggagcatctgccacctgctggggaggcagagaccctgcaatggccacctctttaaaagggcagctgtacagggctaggttttttcaatgaagtttctgtattaaaggagtggctctgggtttgttttttgtcctttttttttgagacattctcctcctctgaacctcccctaatccgacctcctccctgttgggggagagggacggggcagcgtggagaggcaggagtgaggagcgcgggggcctggggccgggctctgagcactgcccgggtgtgcagatgatggggggtttgcatatttgcagggactagcgagtcaggcaggaggtttgcatatgtgaatatagaactccgcagcccctcatgagcagacagacccgggtcacggagactcacaaaaataggtagtgcagggtgggggcagcccaccctgtgtaaacgtgcaacacactcgtgcgaaggttgggtactggacccggctcgatgggcctgtgccgggacactgctgtccactcaggctgaggacagagccccggccgcagggggcagctcactggtcagggtgtgccagcgctccagggctgcgtccggctgctgcaggcagtcactccagtgcttccgagcctcgcctcgggcacctggccccagggacacgccacctggggagcaggtgggcagggtcagggccacctccctgccacttgcccgccctcaacacccgcagccagctcctccctcaccaatgaagtcattggatttgccaatgtcatagtcccagacggtgacttccagggtcttggtggccagagtggagagctctatctcgtagaaaaactcctagggacaaggccggccacccgttcgtgagccagctccccagcccctccctggcctccctccatgtcccgtcccctcctgggtacctcgttaaattctgggttgagagtcttcttcttcacacacgtcttatgcttggatttcttgtccacatcgggcctcaggtacctgggggtggggtggagggagacgaactgaggggtgagggacaggccaggcccaactcaggccagggcaggctccctggggaggagagggtcagagcaagggctcacgtcttgacgtaggggtccgagtaaccgttgacgtccatggcagccagatgggcgcagcgcaagatgcctaccagcagtccccggcgccgcgagctgtagctgagactcagcaggatgcggccacgctcctccagcagcccctgcccctgctccgcctgctccaactgcggggcacagactcagggtcagcctgggcccctgcagcctcccacccacatgcatccccatccccatgaggtgcctcacctccttcagataacaggagatgcccctcagcgccgctgacatggaagagggggacgccagctgagggggcaaagagaaggttctggaagcctggcctccccagggccccctcccctggcgcccctgcagcccccacacagaccgggacctggcgctcgaggcagatgttaaaatgcttcttctgcgaaggcttgaggcggcggaggggcacgcggatctccccaataaactcattgtgactcagcttgtcctcatcacagacggcgatcctggtcgggaactgcagtgtcagggcccctggggtacctgagccccgttccggggtgtaggaagggccttggaccagcccagctctgccctaaacactacgtctcatctggaagacaggctggcacttgagaaggacaagcagatttgcccattcctctgtccctccctctgcagccacccggctgtccctggtccatcaggacatgctcagccattgtgggaagccctcagaaatcttggagcacgctgctcactgcctccattcagggcctgggggcaggagccgaacaccacggtggatgtggccatagacacaggccgtgagagctagaagggccttggagccttgggcagccagaccagtaccccacgcctcctcgggaacccccgtccttttcctgcatgcagcagagagccagccccgcagggactcactaagaaatgattgctttccagccacctgtcctcctgcagtccctgccctgcctccgcagtgacccactaccaggctgggcatctgtggcatggaggatgggcagatcccagccctgccacttctgagccacctgtgtgaccttgggcaagtcacttgatcaccctatgcctcaattcccatctgtaaatggagatagtcaagggaaagaaagaaatgtgaaaatgctaagcctgggctgggccctggtgagcgctcattttttggtctcattctggttttggcctctggcctcccctccattccacccgaatagctgaaaccaaggtggcctctctgctgcacagccctgaccatcagggaaggtcccagctgcaaatccaagcacaaaggcagaggtctctccagagcctgggtttcgctgcccgccacctgacttgagggagtactctccctacatctccatctcctaggatgacggagcaagttccctgtccctgaagacttcactccttaagagattttaggggaactcaaggcacggaaggggcagaccaaagctgcagaggtctggcttaagccaagggctctgagaaggggtctcggcaacccaggaacgtttttgggagggggcagagcttggactgaacctcagatgagcggaatttaggctggcaggaaggagctttccagatagaaaacaacaggaaaagttcaggagttgtggaactggccagttggaagaagggagtcctctgtttgaggggcagaagatacttttgttttgtttttgagatggagtctccatcacccaggctggagtgcagtggtgcgatctcggctcactgcaacctctgcctcccgggttcaagtgatcctcctgcctcagcctctcgagtagctgggatttacaggtacatgccaccacgcccggctaatttttgtatttttagtagagacgggggtttcaccaagttggccaggctggtcttgaactcctgacctcaagtgatccgcccacctcggcctcccaaagtgctgggattacaggtgtgagccaccacacctggcaggcaggagatattgaggggcaggaatggcagggaagaattttggcctgctgccaaaggggctagggagccgctgatggttcttgagcatcagagaggtacgggcttaatgggacatagatcaaccaaccagcggttacaatgtcagctgtccccgagctgctgctgggtggtggggaggggggccctcacctgagcaccttgtgcgtgatgtcgtcatctgtgatcccgctgtaagtcaggtcctcattccacacgggattcagtgtgttcctctgagtcttcgtttttagcttattggcctgggatgtggggatgaaaggttctcaatacctgtcctccagccccacaggctggagtcatgggctgggccgggcggggcgagaggaggctgttaccttacaggctccaggcagcaagtgcagcttgacgtaggggtcggcgaggccattgaaatccatgggcttgaggccctggagaggagggcaggggagagggctagaggctcccggcacctctctccatccctcttgtagagctggaccctggaggagcccagaaggagggggcaagggcaggacgaaggagcaggcctgggaagggaaggaggaatgggccccctctgggggctgcacgcaaaccgggcccgggcttgggtggcagggagtgcccaccttggccctgaggatgctacagtgcagagtgcaggaggcccggtcgtagagaaggtcaaactccagcgtgcctagggcggctggagagagaggaaaggcagcatgggtcggtatggagacaggtgtgtgcgagaggccagcaggtgggcactggctctgtgtgtctctctctcttgccagcccgcgagtgtgagtgcaagaggctgagtgggcccatgcgtgtgtgcgtctgggtccctggctcggccgcaactggggctgtgtgggtggtggagtgtctcagcagaaatactgaatattgagccttgctgaagctgtaatctccacgctgactgcagctgtggtggccgtccctgccacccccccactgccctcctcccctacctacatgcacagccagcagggcccatccccctctccccccaccacggcaagcctggagacccccaccagcacatggggcctccaagcccccagactcactggcatcatccgagtcatagctgtccacctccgcaccatcctcaggcgtggtggccccaaggagggctgcagggggggccagagccagggggaccagatgggcgggggcctccccgccgcccccgccgcccccttcaggtcctggtccccgggggaagtagtcagagatctggcggatgggccggatgggcccggggcacacgttgatggccatgtgctcctggatgttgatggtcatgcgatcgcccctgcggcccctcatgcagcacccctggctaggagagggcgtgtgagccagtgagcccatcatacctagccatcctggctgagggccaggcgacggcctcctcggtctgtggggccctcactggcctcccttcctaggtgtcgagggagagggtggtgtgtgccagccggtggcaggtgggaggcctgggccctgcagaccccaagctgactccacaggggctgggctgccaacccactccttgcagaagtcgaggttgcaccaccccgtcctcacccacccacttctaggttgtccctgtatcatcttgccagctccttcctctcctccggggctcccctctgctcctgagcctgcctgtcccccaaggggccctgcagggccccgcctctgtttctcggaggctctgtcctcctctgcaccaggcgctggtctagtcagggtgtcacccacccctctaggctccaactgcccactgtcccctcattcagccccaggacctgtctgcctgcctggttcccccgctcgctcaccacagcccacggtggagaccccagcctcagatgccacctctggctcctcaggggagccagaaattgcagccgcaggagagccgaacacccccgtagcgcacacaggctggcacgcttccccgcaccctcacgcccccggcctgcccagccccctgcacctgcctctgcctccaacaggtgcccaggcactggggggacggcgggcgcaggctgggcggcggcggccggcgaggagagcgcggagtcgagctgtgcgagccgagagggagggagcgccgagaaagtgcggggaggagggggtgagcgaggtggaggcgaggatgcagccggcgcggcggcg

SEQ ID NO: 73 - DNA, 6439 bp, Homo sapiens
tggcgttcacgcagatcgtcttttattagcggtctgtaaagcacctcccagggtcccccgaccccagattggaggaagccttgagaggtcagtagcaccagggacatggcagggcccgagggcgcgatgtgcagccgatggtgagggactgggcgccctcgcctgcccccggggttgtcagcactgggaaggcttgggggtagcagccacctccttcccccaacccaacagactagttcaaatttgggtaaataaataaaataaataagattcctcaagctggcctaccctggagaggagccgtggttgcagccggccactcgggaggcccgagggccagcgggggttagttggggcgtcctctcctctcgggtgatggggagccctgggggatggcagcataggggctgggatggccttggcagaggcgtctccccacattctgactcctggtccccttgaaaccctgttggtgtccctccccacaagccctcctgccctcagtgggtgggaggcggtgccccctcccctcctccagcgcaagggtgtgcaggaagggggcagagtagggggaagaggtcccctctctccaccccctcagtccccgagagatggggcctcttccctttcggggtcatcgtcagtcctggggttgtccgggcaagaggaccctggctcccaaccccagccatcagccccagagccctgtctccacgggggtgggggtggggagggggagggtcccggcccccggcctcagtcctgggcctggcaggccgggggcggccgggagcggggccagaagaggcggcaggccccacggcagatgaggaagaaccagtagagctgaggggccaggagcagcgcagcgcccaggttgacgtgggcagggatggccaggggcacggccagcaggggcaggccggcatggcgcccgtaggcccagtacaggtagggaaagagcagcacccggcagcagaggaagctgagcagcatcagggccccgttcaccttgtgcagcagtgtgtgctgctgcttgtactgaggagacacagacacagtggccacggcagcagaagggctcggccccccttggccctctccctgcctccctgcgaccctagcaggcagctcctcccaaaccagacactttgccaggacacaagcaccaggtgctcaaaatgcacggggtgagggggggatgacgaaggggctagagcccttggcagcaaccttgaaggtccctccccttcctgtgacctccccattgggctcctgcaccctcccatgctcactcacctggatgaggatcttgccaaggcagacgaagggcgtgctgacctctgccatcaacatgcaacccagaaagaagtctcccttaccctgtcgccacacctgggcacagaggcaggaaggtgaggagctggggctctccctgggttcttgggcagcccccgcccttcctctttcccctctgtcactttgggagatgcttgactctgaacatcagaacacctgggtgcagggctgggtgcagtggctcacgccggtaatcccagcactttgggaggctgaggcaggtggatcacgaggtcaggagtttgagaccagcctggccaacatggtgaaaccccgtctgtactaaaaataccaaaaaaattagccaggcgtgttggtgggcacctgtaatcccagctactggggaggctgagatgggagaatcacttgaactcaggaggcggaggtttcagtgagccgagatcacaccactgcactccagcctgagtgacagagagagactccgtcttggaaagaaaaaaaagagaaagaacacctgggtgcaggagcaggtgcatgacttggctgcatccctctcacggtcctgcagaaagactgtgtcccttatgtaacaggtgaggaaactgaggctcagagacgtgcaaccacaaatccaaagagccacagccgggcatcgtccagcccagggccaggctgcccccacaccctggtgccctgggctggtgctcagtgaaccctgcctgtccacagctttccctgggaatacgctgggtctgcttggttgtcagtacgcagacccggggcttcccaggctcctgccagcaccagcaggaccaaggagcaggccacccgcaccccgcccgcccagctccccgggactcaccactgagagtgggaagcacaccagcaccatggcggcatggtggagcaccatgaggaactccttgtgcaggtagccacgcgctatggcccacgtgctgcccggggctctggccgctccgtcgtcccctccatgccctttgacctggtgcttgtgccagtgacagaggaacatggcgtagatgtcgtagatgaagtagggcacagcaaattgcgtgtaggcagaggacagccagtgtctgttgggcagagagacggggtgggggagcaaggaggaaaggggacaccagtgattggggtcagatctcaggggtcagcacagcagccctggacaggagcggagtcttgggtacagatgagggatccagagggtagagggtgagaaacttgcccaaggtcacacagtcatgcagctagtaagagatggtgctgggattcaaacctgtggtctcagaactcacccatgttcctctctctctgcagtatagtcgggggaaaagaaaagaccagaagatgcccacagaccaaaaggcacagatacagtgccaaaataagcccaggacaggcaggtgggaccttgccatggttatttgtcctaaccttaccatgaggttaggaccagcaacagctgaaggggcgagagtgctggagagagaggtcacaggggtggacgcccattcctgcctcctgggacaggcgatcttccaaacttcccatgcatagccttatttacccctcccaaaaccctgtaaaaggtaggtgtggccatcatccccactgtacaggtgaagaagtgagtcacagaggggctaggtaacctggccaaggaagggacatgggcggtgtggctccacagccctcactgtcatccccaccatccccagaagatccgagaggcatcagagacagaccctgttggcaagtgagaggtcttgtcagcgctgttcgccctgccccaaagtcacccaatctcttgtctattttgtgttgtttttcagggacagccaagcgttaaggggaaaatgcagagcaaaaggagccaaggacaaagaaagttccatgtacttggagagtaaacaaaaacgagaaatggatgaatagacaagacagcatttttcttctggagtcagcacattggcagtttctcttaaatcctgtagtcccaagactggcctggggtgggggcaggaggtcagagaggcaggacctggggtgctcgccccacaaggggtggagggatgaaagcagagtcagccagaagccatcaccaaacatgaggcacgtggaggaggctgtggagaagttggggctgaggcctctgaggatggggagcctgaggcaggcggcctgtgagtggagccaacccattctccagcagggacggtaccagggaaaagggaacctgagactggtgcagtggtgtggagctgcggcccagaggcagggaaagatgagaggggaggggcagctgtagagaacgcgaagcgggaacacagggagagaggtcccaagtggcctggaggagtcagggcaggaagctgcccagaatgcaggcccagcagaggtgatgggagatgggacagctgggctggtgcaggagaccaggaggggccaccaggccctgggctgtcatgtgaggtgttagatcccatccccaccctcttggcaattaggtgctcagaagtaggaacagctgctgccctggattaacccggatcctccccacctacctgaggattaaagcagggaagacggacaggaacagacacaggggggcctggggagcagggggtacagaagctaaacggtgacctctgcatgtgaaggctggggaggaagtgctggatcccaggctcagcttggagcaggggagggaaggggtgggcagaggccaagaagcagccaagtccctgggcggggtctgaagaaagagttaagccaagaactgtcctctgcagctgccacttaactcaattcctctcgctgaagcccttccaggaagggccgctgcctcaccacagaagaggcaactcatcttcgggaaaagaggaggcaaacagaaacagggcaccccccatcaggggcgtccaaatgttccctgggactcagtggctgccacagaagggaagcggtgctgaaagctacaaagggggcgttgtgggcacctctaaggcaacttgcaacgggccacccgtgggtcacctagggcggccgtcagcaccacggacagggcccctctcctccccgtccccccgcctcctgcctgcacacctctgggcctttttggcaaccaccagacactgcagcagctgcctggccacattttggcctcttcaccctcatcccctcccgcactgcctggccgtgtgtggccttgtgcgtgtcatctctcccttgtcctctccctcaggcatggagtggatgccggatgcctggattatgggaagggctgaggggtgagcctggcatgaggagggggcaccccatctgggtgctggctggaaatggggtctgcctcctggggtggaaggcagggaggaggtggggaaccacgacaacacgggagacctggaagccgactagaaagcgctttgaggatcctctctgatccccgctccttctccccctggttctgacctttaaggacaggacaggataaatttatccctgggtgttgagttgcggttattgcagttaacttgctcaggcccaagttaagggcttggggaccacagacagagttccctccaagatgtggggtcttccgggattacccgtacacgccaaccactggcacctgggcaggggggtgtctcgcagcacttactggtcatcaatgatgtgcttgcaggaggtggagacgatgtagccggcagtggaggccatgatggcctggacagaggacaccagcctgggggagagagggaggcgtgctagaaaggcagaagggaagaggcgtgtgccttgatttctcctcgttgctagtctaacgactgcgctttgcgttcagccacttctcgggccagtccttgcctgccttcgcccaaggctgggctgcctgaggtgtgccccaccacaggtacctcacggctctccggcccgctcggctgctgttcctcagtccaccccactccttgccaccttcttccttccccatttgtggaaactgagtctccctcttctcaagcccgcagggtgtctgtcctgaggtgagactgagagtgaactgctggcctggacctctccccacgaggggagcctgggccggttcttgccccgcttagctgtccagtcatgacgcaggcctcactctggaccctttgtgaccccgagttccccagtcactttcccactgtctcctgactgccaccagcctccactctgcactctggccctgttctaggggtgtagagttgtaccatccactcctccatccctggcccccaaacactcaccctgaatgacacctagctgtctggccctggcctcagtccctaatgtcttataggaatgtcttcgccgcatgctggccctgttttggagggtgggagggtgtacggggaagaagagagaggcgggctgaacactagtagaccagatggccgggctggatgaggtctcccagaacagtgagcaaggcaggcagtgaggagagaggaagcctgggggtaaagccccggacccccacaggagctcccagtcccccaccgctgagggtccagagaagtgccaggtcccttccattccctgagaagcccaagaagcagacaggggctgaggggaaagaaagtggtttacctggctgagacaatgactgcgtcggcctcctcccagcgtagctggggcagccgctggagcgtgttcttggagaggaggaagagtccggggaacaccacccccccggccaccatcggggtcagcatggtggctcaggacttgggcagggaggcaggcgggccgtgaaggggcagggaggccgagtggaaggagttaggggtggagaagggacgccaagcccgggaaggagggagaaaacgatgagaaggggcacaaaggggccagggcggggacgggatggggccagggagtccgatgaaactggggagtcgggagggggctggctgggcagagacgggggaggggaggatgggagaaggggagcaggagcaggccagcgagggatggggagaggcaaagaggggatggcttggtgagggacagagaggaagaggggacaggaggaggaggatgcggatggggg

SEQ ID NO: 74 - DNA, 17245 bp, Homo sapiens
cctagcttggcgcggaatccgtgaattgcccgcggcccgagggtgcaggtgatgggtgctgaccgactggggaagcccggagtgtggggactgaggaggggagtggcctggggcgcgctggagcctgcgaggaaggcgccgcctcggatcccccgccccccattccccttcccgaattccaccctccggcccagccatggcctcagtttccccaaacaggaaagggaaggagggtgggcaccccggtctaacggtgcctctcagcctctgagacccagaaccttccttctgcagctcccggactgactggctctgcccttccccatggacgtaagtccgggccccttcccctctctgggccccctcagcgccctctcctaaccccgaatgggcctgtcttccagcacggactggggagggggcttctacccaacagagactacaacctgccagctcaggacgagagctgtcaggaagagtccaggaatggacttcccacgggagggcacatttctggtattcctggcaagataaggagttgactaagtaatccacgagaaaaggcatttccggcagaggaaacagtctgggggtgagagggaggctgcagcatttggggaactgctagggctatcgtgtgtttggaagagggggagggagagaggtaggcagggctaaattgggaattttgtcactgacataaattttaagtgccaggcgtggtggctgtcgcctgtaattccagctactgaggagactgaggtgggaggatcgtttaagcccaggagctcgaggctgcagcgagccatgatcatgccgctgcactccagcctgggtgacagagtgagacactgtctctaaaaaaattgaccaggtgcggtggctcatgcctggaatcccagcactttgggaggccgaggcgggcggatcacctgagatcaggagttcaagaccagcctggccaacatggcaaaaccccctctgtactaaaaatacaaacattagctgggcgtcgtggcgcgcacctgtaatcccagctactagggaggctgaagtaggagaatcgcttgaacccgggtggcagaggttgcatgaaccaagcttgccccactgctccagcctgggtgacagtgatactccgtctcaataagaataataataataaaataaataatagaaaaagttttaagtgagttactgggagccattgacggattgtaagggagggagggatactacacaaggacatctggtgtggaaaggggcaaaattgcaggttggatgacaggagccggtaatgtgggctgagggatggtaaaggagtggcaagggagtcagagacaagagatctctttggagaggcattccagaaggaaaatcagccctagaagactctagaatgctgaagtgcttgatgttgctgaactgggaatgatagggaaaaaggcaggctcagggcacaagataatgagtcagggtgtagtcctgttgacgctctccccaccatctggtggccgttcctctcccagccacctcctcgtccctcatggtattcccgtgttcctgcagcccctctccatctccttgtcaccccttcctcctgtactcgtccaggcctcctctagcccgtggaatccaaccccggctcctgtcagcagccctcccctgctgctccccatccctgccatcgtcttcatcgctgtgggcatctatttgttgctgctgggtctagtcctgctgactaggaactgcctgctggtgaggggtctggtcggggataaagggtgggctctggggaagaggaatcccggtaacctgtcccttcatctgcaggctcttaccctgagacacttgacatttagcccttgcatctatccgttttgtggtaccagggggtccctcctctcctgtccccagccaaaccttttcctttcccctcgggaaagctgccttggctgtcactacctgctgcctattccacatcctgaaccctgtgacctaggcccagggctgctgcgcggacggtagctccccctgcaggaagcaaggttcctccgggcccccagactgctgctggacctgtgcagaagcctgcaactttcctctgcctagcccggcccacttcctggatgcttgctgcccccagcccaccagagctgtgagttccattcctaccccctgccccactgagccctgatctaggtatgatcggtgcattcatttttttgctcaacaacatttattactgagcaccttctcaaggccaggcacggttccagggcatgaatcatgtgcagccaggtaaaaacaacctatcagataatgcctggtgatgaaagctacttgaagaaaataaaatagggtgccagctggagaaaggtgatgtgggtaacatgtagagtacatagccagcacttctaaatgaaagtgagctaaatgaaagttagctaaatgaaaaaacagctcacacagctcctttccgttcaccgaatgaactgtgttctaggtatagggcctctttacggacctttgtttttcccaacaaccctgagaactgagaactaagttgtttttttttctttcctccctccagagctgggtcctcccgtctcctcccctcccctcttcttttctttttgttgttgtttgagacagggtttcactctctcgcccaggctggagtgcagtggtgcgatctaggctcactgcaacctccacctcccaggctcaagtgattctcctgcctcagcctcctgaatagctgggattataggctcacacaactaccatatggctaatttttatatttttagtaaagacggggtttcatcatgttggccaggctggtctcgaactcctgacctcaaatgatccacccgccttggctgcccaacgtgctgggattacaggcgtgagccaccatggcccagccatggttttttttttttttttttttttgagacggagtctcgctctgttgcctaggctagagtacagtggtgtaatctcagctcactgcaatgtccacctcctgggttcaagcaattctcctgcctcagcctcctgagtagtaggaatacaggcgtgtgccaccacgcccagctaatttttgtatttttagtagagacggggtttcaccatgttggccaggctggtctcgaactcctgacctcaggtgatccagagctgggtattttttaaaacctatatgttttttctgattacaaaaagtattatttacaaagtatacatatagaaatacatggaaagtaccaatcactttacaaacccgctctctatcccaaagttgctgtgttttacatgtatctctcatatactaatacagtactatcactgctgtattttaccattatttggcaaaaatggggtggtatcatgtaggttatttcatcatacctgctactgtccccctatcccccgccttttttgagacacgatcttgctctgtcacccaggctggagtctggtggtgcaatcatagctcactgcagcctctacctcctggactgaagcaatcctcccacctcagcctcctgagtagctgagactataggtgcatgccaccacacccagctaatgtttatatctttcacacagatggggtttcatgttgttgcccaggctggtgttgaactcctgggctcaagcgatctgccatcctcagcctcccaaagtgctgggattacaggagtgagccaccatgcccagcctctacttgccctttttttttttttttttgagacgagtcttgctcttgtcacccaggctggagtgcaatggtgcaatctcggctcaccgcaatctctgcctactgggttcaagctattctcctgcctcagcctcccaagtagctgggattacagggatgcgccaccacactaggctaattttgtatttttagtagagacagggtttctccatgttggtcagggtggtctcgaactcccgacctcaggttatctgcctgcctcggcctcctaaagtgctggaattacagatgtgagccaccgggctcagcctctacttgccctttttaacctgacatcacacttcgccacctatccatgcctgtatgtgtagacacataagggttactgtcctcctcctgaagtggggagtaagctggcttagggaagtttagtggcttctccagagtgttacgcaggagagccttgcatcgcaaatagctccacagcgttagctgaggtagaatcctcaggggagaagcctggcttggagaagacaacctgtttctatttgtgggtttaaagatgttaaatgtaatcgaccaccgtcctgaggaatgattattttgagctcagcgattcagacagcaaagcccctgcccttggagtggtgacattccttccctaggatggaaggggaggataaaagcaaattcataacttgggcatatggtgattggtgctaatccctggcatgttttcagttttgaagtaaattgtggggcaaggagcgctttttcagataatcaccttctggtttgccaggggcagtcagcagaggggtctcaggtttggggctgaggggcagaagggcaaaaggaggagaccttgggttctgaaaactcctgtcttggcgtggtggcactcgcctgtaatcccagctactggaaaggctgaggcaggagaatagcttgaacccagtaggcagagattgcggtgagctgagatcatgccactgcactccagcctgggtgacagagtgagactctgtctcaaaaaaaaaaaaccaaagcaaaaaaacctcttgccttagaggagatgctccattagaaaatgatttctggccccctgtcctggggatgccgccccctaccccttctgtctatttgaagtgaatagccagggactcatcacctccttgggagagaggatgggtgaggtgcattgtaaggatagactgggccttcccaccttccccacagagggctgcaagaactttcaaacctggagacatcaggccctgatcctctctggtttctgctggagctaggaagggatttaacagggtggaggacagggcaggttctttctgtccttgagctgtctttccacaaagtatatttaagtccctccctcttcagtttccttgtaataacagcccagaaggttacaaatgtcttgccacttggcagctgtagacactgaggcttacggaggttggagtgacttggaggttatatggctggatcagctggaatagaaacccaggtttctcttccttactgagggagaaacatgcctgctcgcctgctctgcttcttttttttttcttttttcttttttttttgagacggagtcttgttctgtcacccatgctggagtgcagtggtgcaatcttggctcacttcaacctccgcctctcgggttcaagcgattctcctgcctcagcctcctgagtagctgggattacaggtgcccgccaccacacctggctaattttttgtatttttagtagagatggggtttcgtgttagccaggatggtcttgatctcctgacctcgtgatccgcccgccttggcctcccaaagtgctgggattacaggcgtgagccaccacgcctggcctgctctgcttctttcatgtgcatgttgcaaggttctcattcattcattcattcattcattgactcactcaccaaagatttatggagttactgttgaggcactgtctagggccttggggactcagcagaaacaagatggagaaggtccccagcctcgcagggcttccattctggtgatggagagagagaaataaccaggccattacaacagagggtgagaaatgacgtgctatggagcagcggttgctcagccctgcatgcgatcagaagcaggtataggacttaaaaggaaagccaggcatctaggccccacactgaggtctgggctggggctagagtttgtgaatcttttacaagttctcatatgattctgatgcacacaggttaagaaccactgctgagggaagaagctatgataagaatagctctctttcaggccgggtgcggtggctcatgcctgtaatcccagcactttgggaggccaaggcgggcagatcacaaggtcaggagttcgagaccatcctggctaacacggtaaaaccccgtctctactaaaatacaaaaaaaattagccgggcgtggtggcgggcgcctgtagtcccagctactcgggaggctgaggcaggagaatgctgtaaaacccgggaggcggaccttgcagtgagccgagatcgtgccactgcactccagcctgggagacagagcaagattccgtctcaaaaaataataataataataataatatctctctttcttttttttttttttcccaggcagggtctctcttgtcacccaggctggagtgcagtgctccctctgttgcccaggctggaatgcggtggcgtaatctcggctcactgcaacctccgtcccccaggttcgagtgattctcctgcctcagactcccaagtagctgagattacaggcacctgccaccatgcccggctaaagtttgtatttttagtagagacaggttttcaccatgttggccaggctggtcttgaattcctgacctcaggtgatccacctgccttggcctcccaaagtgctgcgattacatacaggcgtgagtcgccatgcccggccaagaacagctctctttcgtccagcactcattacttaccaggcatcgtgcttagttccttccaccgattcccgacaatggccttatgaactaggtcttatattttttcattttattttattttattcttttgagatggagtctcactctgttgcccaggctagagtgcagtaaaacaatctcggctcactgcaatctccatctcctgggtttaagcaagtctcccacctcagcctcccaagtagctgggaccacaggcgtgcgccaccatgcccagctaattttcgtatttttaatagagatgatgtttcaccatgttggccaggctagtcttgaactcctgatctcagatggtgcgcccaccttggcctcccaaagtgctgggattacaggtgtgagccaccacacctggccttaggtgttatattcctataaatgaggaaactgaggctgaaaaaatgaattagccaagctgaggttcaaacccaggccttactgactctagggcctgagctttaaccatctatacgatgatggctggctctcacagagacaacaggaaaaattcaagtgaaaaactctcctgagagccaggagagacacaagggttaacagtcttgcggagtccttgtttaatgtacttaaacagcagattccttccagaagccacatggctgcttgtaacggttgagaaatccattagccagttattaatgacaagatctaaacccttccaagggagagagccaagaaatgcttttaataccctcttttctgaggtaatggcagcagagcctctctcagccatgggttctgtgcacagaatgatggtgtggtccttcaaaagcccgcagaagtgatttcatccccagactgagactccctagagacaccccaaatcacaccctcatcaaacacaagaaaatcacttctctctcccccttccaccatgacggttctagcctcccccaaggaggcagttctgttgacagtagcacagcccaattcagacccctgtccctgcaggtggcaggtcccctcccctcactgcagcccctagtgatatctgatctcaccagccatctgacaccacaccctgaaacctcagctgttggaaaggtcattcccctattcctggcttggccaagtttctgattgaactgtacaactgtgactgtcactacctctgcctctggcctcaaggagccaatcttctgtcacacagccatcctgggccacttcagccatttggcctgactccagcccatgcctaaggcagttgcgggtcatccctgtcccaggggaggacagcagtgcactggatagaccagttctcccttcttgtctctaaggacacgctgctcctattccccaaagagacagacattgtttcctccaggagctgagaagccctcttctttcttctttgcctaaagaaggcaaatgatatgcttagattcatccattcattcagcattcatttatatctcagacacctgctgagcatgagtccagtgctagctcagtggagaatatgggatgagctgcccctgccctggcagacccagagagaggctgatgctcctggcactgggaggcagagggctcaagagggattgcaggcaggactgtacatcccagctccattcccatcacttgcctctctgtctatgcctccatttcctttttttttttttttttttttttttttttgaggcagagtcttgttctgttgcccaggctggagtgcagtgggtcgatctcggcttactgcaacctctgcctcccaggctcaagcgattctcctgcttcaggcttctgagtagctaggattacaggtgcaccccaccacgcccagctaatttttgtgtttttagtagagaagaggtttcgccatgttggcccagctggtcctgaattcctgaccttaagtgatccgcccaccttggcctcccaagttgttgggattacaggcatgagccaccatgtctaaccatccattttctcttttgtaaagaagcccattactcaggattctggtaattaaaaaatataaggctgggcgcggtggctcacacctgtaatcccagcactttgggaggccgaggtgggcggatcacctgaggtcaggagttcgagaccagcctgactaacatggtgaaaccctgtctctactaaaaatacaaaaattagctgggtgtagtggcgggcgcctgtaatcccagctactcaggaggctgagacaggagaatcacttgaacccgggaggcagaggttgccccaagctgagatcccaccattgcactccagcctgggtgacagagcaagactccgtttgaaaaaacaaacaaacaaatagatctaattcttttgaaaacattaaaattgattgggcgcagtggcgcatgcctgtaatcccagcactttgggagaccaaggtgggtttagcccaggagtttgagactagcctgggcaacatgatgaaaccctgtctctacaaaaaaatacaaaaaatgaattagccaggcgtggtggcacgtgcctgtaatcccagctacttgggaggctgaggcaggagaatcgcttgaacccaggaggcggaggttgcagtgagccgagaccgcgccatggcactccagcctggcaacagagcgagactccgtctcaaaaaaaaaaaaaaaaaagtacaaaaaatgagccgagcacggtggttcatgcctgtaatcccagcactttgggaggccaaggcgggcagatacctgaggtcaggaattcaagaccagcctggtcaacatagcgaaaccctgtctctactaaaaatacaaaattagccaagtgtggtggcacatgcctgtaatcccacctacttgggaggctgaggcaggagaaccgcttgaatccagaggtggaagttgcagtgagtggagatcacgccattgtgctccagcctgggcaacaggagtgaaactccatctcggaaaaaaaaaaaaaaaaatggccgggcacagttgctcactcctttaatcttagcactttgggaggctgaggcaggtggatcatctgaggccaggagttccgagaccagcctgaccaacatggtgaaacccccatctctactacaaatacaaaaattagctgggtgtggtggctcacgcctgtagttcagctactcagaaggctgaggcagaactacttgaacccaggaggtggaggttgcagtgagccaagatcgcaccattgcactccaccctgggcaacagagtgagaccctgtctcaaaaaaaaaaaaaaaattaaaaataggtaaattgccattttcaaagatacctgtaaagatttttaaaatcattcatgaatgcggtctgttcgttgcacagagtagatgctcaaaaatggtgaatgagaccctctattttggtctcatgctgaagaagtccataaagcccacaagtcattttcatgatggacagaaaaatgtgtgtgctttctctgtctactgcctcaactgcacagaccccgggactgtagcagaaccatcttttgagcttgacaccgggaggcccaaattctagcacgggacccagggccagttgctctctggtcctcagtctcctcacccataaaatgggaaggagagaaccctgaatcattgcttctagcttctgaactcagttgttcagaacaaggactcactgctgatttttcaacagcacagggaattgcactgttcctgggaatgatggacagtaccctctgttccactgggcaagtgagatttcccaggcctctctgttcccttctccccttagagagcaacagacgtggccccatcccacctccctcaaccctctctctcctccctcaggactgggcacctcgctgcccccgctgctgcccactctgcgactgtgcctgtacgtgccagctccccgactgccagagcctcaactgtctctgcttcgagatcaagctccgatgaggacccagggcccctgccctctggggagcggccagcccccagggcccatgtgccctcctccctgaagagcctttccccacgccactggaaccacagatggcctgccgagcacccaggcctgggaactggaagtggcagcgcagggcctggctccctgcagggcaggactcttggccggctggacggcagctcctctggagggccagaaaagagaggggctagtgctcgggcaggtgccctggcttcccttcccctccacacgtcaacgattctatttgaagttgggcaggggggtggcgctgctcaccacacacaagtgttataggaggagtctggcccttgagtaccgggtacgcaggggtgcctcaaccacactccgtccacggactctccgttattttaggaggtgagtgtagtgccagtatctactctccttcttaaaaaaaaccagggctccagagaatcagaacagccaccatcaccgcagggagtcaagggaggagggagattagagaaggagccagggagggtggcagggaggccacgtgatccgagtcccctcacccctttccttcccacaggtccctggccaaagatttatttctcttgacaaccaagggcctccgtctggatttccaaggaagaatttcctctgaagcaccggtgagtgggcaggggctccctccccatcaatagggccgacccaagtcttcctcccccttcccccatgccgggccccacgatagtgtgaatgtcaggggcttcaggtttccctaaatataggtccctgccagaggatccgtggcgggaaaagggcaggggtcattagagaagatcggggacacatgtggggcgggcaggagctgccttataaccagcccgggaacccctagctcactcgctgctgaccaggctctgccggctccttcggcctcgccgcaggtgggccccttgcaggaccgggccggggtggggatggggttggggttgggccaacagggtccagatggggtccaggtgaggaggggagatttggacgataggagcagggggctcagcatctgggaggcagatcagttcggggacggattttcttttggagaaggaagtcaggctcaaggaagacgtttggcaggaactgtgaccccgcatgccagaggccgagcagcggccggtgcatagccgcgcattctggttttctgtggcgcagaggactaccagcctggctgcggcggcccggcggagagcgcgcacgcatgcgcgacccagcccggcctgccagcctggaactcggatggggaggtctcgcctccgcgcgccgctagttccgccgccttctcgcgctccctgcgtgtcctctcgatgccctttcctccgcctcccttacgcctgggccagtgacagggtgtcggctccgcgccgattcagcccgcgggcgaggcaggctaacgcacgactgcgcgatgtggcccctatggtgacacgcgctgcagccgcgaagaccggaagctggggcggccccgggccgcgcgcgctgggcctgggaggcgaaactcagcttccttcgtttccgacttttccatccgcgtcctccacttccccgttccgccctcccccattgccaacattctggctgagtcacggcgccccagagcgcgccaggctgggggaaaggagcagaagggagggccctagcgacccgcgggatgtggtccgagtcacgtccgaggggggtggggagggatcgtgttctcggcgcccgccccttcctagcgcggcctctgggctgcgcctctcgggggcggcccgtagcccagtccgtcgcctgccattggacgccgcccgctcctcgtaaaggaaaaagctcggcggagggcggagtggtgcctttaaaaggccgggcgccgccttccgcctgcccgcctcctgcgccgccccttccgaggctaaatcggctgcgttcctctcggaacgcgccgcagaaggggtcctggtgacgagtcccgcgttctctccttgaatccactcgccagcccgccgccctctgccgccgcaccctgcacacccgcccctctcctgtgccaggtgagcgcccctcttcacgtgcggggaccagggaccgtggagagggatcttgggggcagtggcgggttgggcgtccgcgtggaggcctcccccatcccatgccagcgtctccccactaccaggcacacacaggctccccggcccctccagcctgaggtcctctaactgcgcaatgcagcggctgcgcgcgctgagtcatggcgggggaggaagccggacgagatgaaggaccattctcccccttttcttgcagggacccctgtggcaaaggattagggccccttagccctggcggggatcctaagaggcagtgaggggtgggggccggcccatgtacagccccagggttctcgcaagtgggagcttggtttctgtcctgggaaacggggcgcccttcgcgaggagggaaacccctccgcggtgcttgatgcccccttaacactttccctgtctctccttatcgggcgaccttgattctgagcccggaacagctgcagccatgcgaagcgacgggagcatttttcaggggaaggcgcttgctcctccacgttcttgccccgtaggaacagtgacgatggcaaagcttaccgctttcctcgcctcgggctagggcttgttccgccgccctttcctgggcttctccttgctctcttatatttttcctaatgcccctttcctaccacccgccccctcccttgtggggaaaagcctgaccttgggatgtccttgaagccttggagcccgggccagccctgggatcttgaggggattggaaggaacaccccagtggcagtcagaagagctgggttctaatctcagatctggctccggggttgctgtgtggcttgaagcacagacctttcccatatctgggccctttcccacgagggtgttgggccctctgcttgattcacgatctttacattctaaaatactccggttcggttttgttttcaggcaaggtgaccccatggcaaggcgcaagccagaagggtccagcttcaacatgacccacctgtccatggctatggccttttcctttcccccagttgccagtgggcaactccaccctcagctgggcaacacccagcaccagacagagttaggaaaggtacaggggcaggcctagcaaagggaagttgggcgtaagagagagctggggaccagaagtgccccagggcctgctgggtgtggggcaggggaggtagggaacatttccctgacctccaggagaggggccctggtcatcgggagatgatgggaaaccctagctaactagtccttcccctctgtttcctgtatccaggaacttgctactaccagcaccatgccctaccaatatccagcactgaccccggagcagaagaaggagctgtctgacatcgctcaccgcatcgtggcacctggcaagggcatcctggctgcagatgagtccactggtgcgggcaggagacagaatgggtggagggtgcagggttgggagtggcaggctgatcccctaattcccatgtgacactcccagggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtaaggggagggcctccggacgtgaggtttgagatggaagtggaggaaggaaatccaggttagtgaggcagggaatgaatgctggattggtggcctagagacttgcatggagcctgcttcaggcttagggcatttactcgacatttttaatcctcacaattctgagagaacagtatcattcccactttacacatgaaaatctcagaagctcagggaagtgaagtgttttgctcagagtaagtggcagagccccagtctgacacccaattcactcaacatttctgttgtcaaataacatcccagtgtatcctgtctcagaggattgttactaagtgaactaagtgaaaatattttaatttaattgtaactaagtatttgagtaactaaacattttaagtaaattttttttttttttttttttgagatggagtctcgctgtctcccaggctggagtgcagtggtgcgatctcttggctcactgcaagttccgcctcccaggttcacgccattctcctgcctcagcctcccgagtagctgggactacaggcgcccgccaccacccggctaattttttttgtatttttagtagacactgggtttcaccatgttagccaggatggtctcgatctcctgatctcgtgatctgcccacctcggcctcccaaagtgctgggattacaggcgtgagccaccatgcccggcttaagtaactaaatattttaattgtaactaagtgaaaatatttgccagccctgagatgcagtttaagggattaagtaaatgtgggggaagactggggctaaagaagaggaaagaggggcacgcccagctacctaggaggctgaggcgggaggatcacttgagtccaggaagtggaggcttcagtgagctgagattccaccactgtactccagccggggcgacagtggaaagggtgctagaggtcatttcctgtgtcttaatgttgttaccctgaccccaacaggtagacaagggcgtggtccccctggcagggacaaatggcgagactaccacccaaggtgagaactgtttgattctctgccctacgaacccaaccagagcaggtttgggtgctgggaggagtggaaaccacatgcccctccccaccgtgctctgaccccttcctcttctcttagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcaggtgggcctgcaggtcctcaataggcaacctcctacctcatttggttccagtgttgttaatttgcctattacctgccatgatgcctacctccccaaaagcaagcattagctttggcccgtggaggacactcaagggctgttgaaggcagaggggccaaggagggatggtgggtggatctgaggcggctcttgtctcctgtaatctgagggctttgaagcctgagtccctggcatcatcaagatacggtcttgaccagtggctgtggagagatgtaggtgggactctgggttaggaggcctcacagtgaccctgtccctcgccctgcagaatggcattgtgcccatcgtggagcctgagatcctccctgatggggaccatgacttgaagcgctgccagtatgtgaccgagaaggtaaatggctacctgcctgaccagtgcaaggtggctggccggggaccctggggctaacccctatcctctcctccaccccactacccaccgtgcgcctgctctgctccaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactggtgaggcccacactcatcttgatctctatgcagtagataagctccacccacaaccctatgcccatttggacggatttccatggcaacttccaccagctcctgccagcttcctgggtctctgaccacagcccctctcgcctcacccctgctctacagggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggtaaggataggcaggaggtgggcagggtgcctgggtggatgggactcggagaagagcccttctcactccacccctctccctgcttaggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaaggggga

SEQ ID NO: 75 - DNA, 9311 bp, Homo sapiens
ccggagagccggaaccggagtcgcagcggcggtaatagtgcgagactcctctaagtcaccgtccttagcgcgggaccgcggggttcgacgggagttagcgggggtgcggccaggccgttggacgccggggggtcctggggccgatgtgaggggaggcgggggtgggggagccgggccggctctagaatcgagttgtccgctccgagccccggacggacactgatccgcgggctcgtcttggcctttcccaggagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccaggtgagctcgttggccctggggaagggaggccaagccgccgcccacgggttctggcctggggcaaacccaactgagaactttgggcttgcctcgttctggaagctttcccagagaggagcaggatggagccgctgccctcgaggaaaagctagcctgctcggggaagacagagtggataaagacacttaaagtttattagacgatgtgtttccagtggagtaagagtgttacataaagtacttaggaaactcaaggaaacaagtccatctgtcgggggacggaagcttgttggaggggggccgaactgtgggagaggcctcgaataaggaggtggtaaaagagtcagccaaaaaccaaaagtttaagacaggaaagttaaagaccctgtgatttataaaagtcttctaattacaacaacccttaaagattggtggtattgtactcattttacaggtgggaactttcatgttcaaagttacccacaagtaaggaatggggtctgaagccagctcttagtgtcctgtcctttttcaggccataatgcaaaaaggtggagttggatcattcacgttcagggtgggagcctgagaaatcgtagcaagtaagccagggtagaattaagcacgatagggaggccagttcagagttctgtgggaagtaggatgatgtagtggttaaggctctaggttttgcagtgtgagatggctctaggtttgaatctgaactctgccgctttctagctgtgttagtaatcttaagtgtctttatttgtaaagcagaattaatagtacttaataagatgattgtgaagattcagtgagttggtgctggagatgaggttagcacagtgttttggtacagcatacgtgcttgataatcaccaggtattctatttcttttggaagagggcaataatgagatgggctaaagccatcagggagggcttttgagtggaggtaggccttgaaggatgaagataatttggctagctgatggaggcagggccagtgagggaagggcattccaagcaggacgaatgtaacagtggaggccctgagatgcgtggggaacagtcaggggtttaattacctgcctcctctggggaactgtgtgattgtggcttctaccaggctggagaattgtggcagaagagcccacagaattaccctacgtttattgaacagtaaacattggcctttacagggccactatttggcctggcccggtactggcaaaaaacttctatccatctcttccccccagcaatcctatgaggttggaatcatttgctgcattttatcgaataggaagccatgactcgtagaggtctggtgacttaactgaggtcacccactgaggacgtggcagagctgggtcctgaatctgtggccctcaggctctttgcctggccctgcctcacatagactacctgcagccagacagggcctgtgaggggatgatgagcagggtcggcctctttttcgccacctgtctgtggcttttctcttttgccagctgaccagaccagccccatggtgtttttagttgtcccctttccctcagtcctgattggcatttttaggaacttaaacctgttgttgcctggcactattctttaacctcgaagtattgtctccctcacgggccctggatcagtgtggtggtgatggtagacaaagcttagatagcatgctggagtttgcagaatagcaggaagtcgtatattcagtctccatggctccttgcaacagcctaaggaatacgcagggtgggctgagtacttagccccatttcatagcagaggaaactgagcctttgagtagataatgtcttgcccaacatcacgcagctagtcggaggggaagttagttttgcatccaggtctttgactgtgctccgtggtcactgagagccaggcagaggcatttagattttgatgtggggtgtgaggcagcaggaagccatggaaggctgaggggtggagggtcctgcccagttgaaactgagtggaactaggaggtactaggccaaggcctgagttggccgctgttgtcccaggctcagtctgaagcagggccatctctgatacctggttatggcctcctggggacccatcagagacccaggctgaggctggtggtgtcaagagcaccagcttgcctagagggcacagacatgcagatgaaaccagtggaagcacagaggtccgcagtgtctgagctgaaattgctgctactagaaatattagcacagtaggagagctgagcttttgaatcaggtggtcttcagtatgaatctttgccttgtcacctagaagcaatatgaccctcgtcaagtcactttctgattttttgaagtgataatgacatgcagttgagagtccgggtatccgggcacagggcctgctgcgctggtagccgttactgcaggcaggtcctgatagggctggggaagtgctgcaagtggcagaactggggctggaatctgggcctgattcccaggccacactggggttgcgctggcactgaggggggctttgcagagagcacgggccctgcatgtgacctccctgggcttcaggttttcactcagggtctgtggaaggggctggcataaattctcaggaaattgggcttctgggttccaatttagccactctccagcttggtgaccttgaccctcccgcttttctgtaagctttggtttctttttttctttttttttttttttgagacagagttttgctgttgttgcccaggctggagtgccagtggcctgatcttggctcactgcaacctccacctcctaggttcaagtgattctcctacctcagcctcccaagtagctgggattacaggcacgcgccaccatgcccagctaatttttgtatatttactagagacggggtttcaccatgttggccaggatggtctcaatctcttgacctcatgatctgcctgccttggcttcccaaagtgctgggattacaggcatgagccaccgcgcccggcctagcttcggtttctttactgttacgtgaggctgaagagaacctccccagtctgttggaaaggtcactatgagcagttgatggggaaggatgttcagcacaagaagcagtgcaggtgggagagtccgggtactgatgtggcctcttggaccaccgccagtgctgccttctgttcccagaaagccagggcagacctccttcgtgctgcctctgccatacagagcaaggggcataagtgaatcctcctgtccactgagctcaggaaactcattctaagggaagagattggcagaaagaggggggccaggcgagttgggcctcccacatcagaatatcttgataaagagtcagaccccagagccaggcttccctggttcatatcccacctgtgtcactggcaccaagccagcctccttccctgcttcaatttcttcatctgtgtaccgggaatcatcatagtacctgcctgccaagctcttaataacatttgtggcacacagtatgagctcgaatgttcactgctgctattaccaggcaaaatttggaaatacagtgttgcttaaattgggtatctataggctgggtgcagtggctcacatctgtaatcccagcactttgggaggcaaaggtgggtagatcacttgaggtcaggagttcgagaccagcctgggcaacatagtgaaatctcgactctactaaaaatacaaaaattagctgggcgtggtggtacatgcttctaatcccagctactcgggaggttgaggcaggagaatcacttgacccaggaagcagaggtttgcagtgagcaaagatggcgccactgcactccagactgggcaatggagccagactctgtctcaaaaaaaaaaaaaaaaaaaaaaaattgggtgtcttacctggcaaagtgatttcatctcctgctcactcaagtagaagtagactgcactgcaaggagaaataaaaaatatttaagtcctcatagtcataaagaaatactgaacacatggcaagagcacctcacttttttttttttttttttgagatgaagtcttgctctgtcgcccaggctggagtgcagtggcgcgatcttagctcactgcagcccccacctcccaggttcaagcgattctcctgcctcagcctcccaagtagctgggattacaggcacgcgccaccacgcctggctaatttttgtatatttagtagagacagggtttcaccatgttagtcaggctggtctcaaactcctgacctcgtgatctgcccaccctggcatcccaaagtgctgggattacaggcatgagccaccgcacctggccaagagcgcatcactttgaaggcgcatccactgtgggcctgccctgggcacctacccttgtgtctggatagcctgggagaagggctctgtgattggccaagggtgacttaagctctgctgtggagaggatggggagacccgcctcccaggagtgagtcctggatgcggaagagggagcggcagggggagtcagggctggaaaagtcccagcctgctcagaaggcctggaacgctgggataagaggttggactttgtccttttggcagcagggggccacggaagggtgttgcatgctgaagggccgtggtcagcctgttttggggagactgtacgcttcactcctgccccctggagcttccaggactgcctcatatcctcccctccccccaaaaaaggtcaggaattgggctgggctggcctggctgtggtgaccctggtcttctcctgtctccagagagatcttggtagaggagagcaacgtgcagagggtggactcgccagtcacagtgagtacctgctgtccctgcagagccaggcctggtctttcaggcacatgaagtttcctcttcatcttgggggctctataagcccaaccctaagctcttttatctgtcctttccctcaccttcaacggagcactgctaaaagaagtgggggttgctgtgcacgttggctcacacctgtgatcccagcattttgggagggcaaggtgggcacatcacttgaggttaggagttcgagaccagcctggccaacatggtgaaaccgtttctactaaaaatacaaaaattagccacgcgtggtggcacgtgcctgtaatcccagctacttgggaggctgaggcaggagaatcgcttgaaccccagagttggagattgcagtgagctgagatcaggccactgcactccagcctgggtgacagagggagactccgtctcaaaaaaaaacaaaaaaaaacaaaaaaaacaggccgggcgcggcggctcacgcctgtaatcccagcactttgggaggccgaggcaggtggatcatgaggtcaggagatcgagaccatcctggctaacatggtgaaaccccatctctactaaaaatacaaaaaaattagccaggtgtggtggtggacacctgtagtcccagctactcgggaggctgaggcaggagaatgacgtgaacccaggaggcggagcttgcagtgagccgagatcgcgccaccgcactccaggctaggcgacagagtgagactccgtctaaaaaaaaaaaaaagaaaggaaagaaaagaaaggggttatgggaagggactttggatttgttagtggagattcttggccagggcagaaggactcctatttggcgagtgattctgctcacatatctccagggctctgtgttagtaacttgattctgggtactttgtggggagtagagagaggaaggggccgggacatctacctggaaggacttagttctagctcttgcctacagaatagttggtactcagcataggacagtgggtatggttccagaccagactgacttggggtgggagaggagaattttggtcctaggaagtagaagtgcagccaagagtgataaagctcactaaagcagcgggtgtttggagggtagtccctggcaactcccactgcttgagttccaaccccactcttcctgttccccaggtgtgcggcgacatccatggacaattctatgacctcaaagagctgttcagagtaagagtgtggccaacactgtgaaatgtaacggggggatgactggaagacccctgtaattgagggtgggagccttaatttggggcgtggagtgggggcaaggggccccaagttagatgggtggttgtggaagaagggcctccgctggacagaaacaggtagggggtaggggactgtttacgacagggcaaaactttctacttccccacaggtaggtggcgacgtccctgagaccaactacctcttcatgggggactttgtggaccgtggcttctatagcgtcgaaacgttcctcctgctgctggcacttaaggtggcagtccccggcttctgcacccccaacctgggcgacctcgggccgggcctgtcttagtccgttccgccctcatctcctatcgtgaccagccccaccttggagctgtgtcactggtgatggaccgattctgcttttgggggtggtcagagacttgatgggggttgaggccagcggggcagcattctgggaggggcagaggctcactgttgcgaatgtggcaggtcattgatgccactggtgggagaggcagtgtggggccagatgacaaagggcctgggtgccttgctagggacccggtctgtgtctggtaggtgaaagaagagccattaggttcatagttgagggaatgggtcagctttacattctctggaggggtcgtgtgggcctgggaggtggctgatgccacacgattcaggcaagaggtgccaggagtgtgctgggcagtggttgtgaggatggcaggctggcgggcacgaggaggtcagagagggatgtgtggagagaccgtctaggcgccagccctggcttggtggccacccccaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaaggtaagccagcccagggctccatgggacagggagaggaggggggcttcaggcctcagccccgtcctctttccctgctctcccctgtagatcttctgcgtgcacgggggcctctccccctccatccagaccctggatcagattcggacaatcgaccgaaagcaagaggtgcctcatgatgggcccatgtgtgacctcctctggtctgacccagaaggtgagggcatgtgggcaggggcaggcagggacagccaggaggggttgggaaagagagggagcagggctggtcttcactgtcactcgtcctccacctgccaaatggctggaaccctggaggaggagcagggaggcctgcatggcaggtgctttgagcacacagtggcttggggcatggcccagagggctgtggaggacaaccaagtcatggctccctgaagtgaaggggccttagaacatgacagcagcttcttcagaggtcagaaccccagaatggtagccccctgagacccctcattttgtgggttttccactagtgtagagcagagctgagatttaaagtcaggtcttctgaggaccagccagagttcctgttgtcacaggcacacacgcacaggcagcctctgctccagcgcagacacacacacacatacacatagcctctgctccatcacagccacacacacgcacacgaggcctctgctccatcacagccacacacatacagacacacacatgcagacacacacatgcagccgctgctccacagtcactccggacctccctgtgacaacacagggtgcccttctgtctctgggagtgcccctttcactcttatgtgctgtttggacggggattgtatgatcactgtgattatgagggggccccaggcattgggcgttctttctcctctggagcttatctgcccctacatttgctgtcctggtccccgccatcccacagaccatattcaggccccatgctctggtcccacgggcctctggtggacttggggaggggccaggctgctcaccctcaaggggcagcgctggcagccagagaagcctgaggacatccctctccatccctccctttccgcatcagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccggtgagccggctgggccgggctgggatgggcgggcatctgagccgagctgctcctgaccctgctgccccgccttccagctgtgggaatgtggcagccatcttggagctggacgagcatctccagaaagatttcatcatctttgaggctgctccccaagagacacggggcatcccctccaagaagcccgtggccgactacttcctgtgaccccgcccggcccctgccccctccaacccttctggccctcgcaccactgtgactctgccatcttcctcagacggaggctgggcgtggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatg

SEQ ID NO: 76 - DNA, 3887 bp, Homo sapiens
tgtctccactccattgttttattatgtacaaacgctacagaacgagggggacagacacgcgtggggtaagaagggcctggtgggaggagttcacagagcagacggtgcactgggaccaggagagcagaacacaggccataactatagggcaggtggggcaggaacgggttaaaaacgagatccaagccagccagatcgcaggaggtgcgggggcgtcgtcccccttctgttctccccccaaggtcacagtgcatgcaataaaatatatatacaggagctagatccgtcctctgcaggggctctgagggtccagagctcccttcgggtggcgggaagccagtggcgctccctggcggccaggccgggctggagccacatgcgtcgggggagcgggggtcagtcccagccgttgtctttgatcatgtggttgagttcaatgatgtacttcccctctttgtacttctggctgctctcaaaggcctgttcctgaaaggaggggcgggaccgtcatccccggagcaacagtctcaccacaaggcactggggttgggaagtggacatgagtggccccattttacatatgaggaaactgtggcccagaggggcagggccgtatttctcacaaacacagagtagaatagaactccctgactcaaaggtacttttttaagtactaatgatggctccaacagagaagatagggaagtggctaaaagatttcacagttcagggtttgcaaactggtagcttcatggccattttggcctacaacatgtattatgtttggacagcagacagtttaataaaaataactttaaagtattaaaatataagtaggccttgctcactccagtttgcccagcctgcccccaactcccaaccctgccaatctatgctaccctttacacatctacagtatctgcttggccttgcaggcacttgaggtttttttgtttgtttggttttgagagggagtcttgctctgtcgcccaggctggaagtgcaacggcgcgatatcggctcactgcaacctccgcttcccgggttcaagtgattctgctgccttggccccgagtagctgggattacaggcgcccaccaccacgccgagctaatttttgtatttttagtagagatggggtttcaccatgttagtcaggctgttctcgaactcctgacctcaggtgatccacctgcctcagactcccaaaagtgctgggattacaggcgtgagccaccacacccagcctggcacttgagtttttgacctcttgtttaggccagctctttattaattattattatttttgaaacggagtctcgctctgtctccgctcactgcaaggctctgcctcctgggttcacgcaattctcctgcctcaacctcatgagtagctgggactagaggcgcccgccaccacacccagctgattttttttttttttttttgtatttttggtagagatggggtttcaccgtgttagccaggatggtctcaatctcctgaccttgtgatccacccgcctcggcctcccaaagtgctgggattacaggtgtgagccactgtgcctggccggccagctctttatttggtagaggtccagagtggccaagccacctgtccagagacacacagccaatctgtggcagggtcagcagcgagctcaggtcagggctggctggctggctctgcctgggacatccacctcacagaggcaccacagttccaagcgacgcctgaagaatcctgtcccttgcagtgtcccaagagcatcttcctgagcatctaatctgatccctgtaacaatcctgggtgctaggcagtggctttatcttccactgagagataaggaaatgagactcagggtagtgaaatcagaccctggacagcagcagtggcaatgaggactatggaaagggaggctggtgaacccaagctccatgttgttgcagagtctggggcaatttttctgatactctaaatgacaatataagctggtgaccaagggtttggagtgaaaaaaaaaaaccaaccaaccaactcagattctggtccctattctgttacttaccagttgggtgatcttgggcaagttacctaacatctctgggcctccctgtcttcttctgtagagataataatagcttctacctagaggatcactgcaatgattgaatgagataatagacgccaggcacacaacagtgcaaggcacataaacattccataaatggtgactctgattatatcctaactctctaatggggatccaagtgcctgggagagaagggatgggttaagagaaaagttctacaccccttgcaaggtgcaagataaagagaatgtggtcagggatgctgacttgtgtgagctcggcctatgcaatctgaaaggctatagggtgacagcttgtcaggaggaggtgttggaaggtcaggtcaaaggctagcctggggtcagaggtgggtgactcacatatttccagcccaaagtggtcttgcagttctcgcagtggatgtcggcgacagcatggaggccggtcagcagcacccgctcctcggctggcccgcagcccacgttcaccctgtggggacatggggtagtcccagggagggtcctgccatcacagggcccaccccctcaagcactgtgtctgtcctcagcatccaagaaatgatgctcacaatttcctgcctgcaccggggaactctgggagtctcagcaggatgccaggggtcacaggtcacaacagaggtcagggaaagcaagaagggaggccagatactcacactgagttgaagaggtaggcacgcccctgactgccctggaaggactaaagggtgagagggtgggaagagaggagggggtcagggctgccggtggggagctgccaggcagcccctataggttccagccccactgtggcctggttggttaccttggagatgaggtcgtcgtggttggccaggtgagcgcggcagtgggcacagctatacctccggtgacaatcatccaagtaggcctgaaacgtcttgggctttgaaatccgcaccatggcgggggccgggggcagtggccccacgcggggagcggcccacggggagcagagggagcccagtgcctgccggggagggagtaggtgggctgtcaggacctgggccacacacatgcgaggcactcccagagccgtggggactcgctctgtcacactgggctgctctctcctttccccagagccagcagcctctccggggaccagaggcgtctcggttttgactcagtgaggaggcctcaggttgcatccatggggaaactgaggctcggaggtgcccagggtgagtcacccgcctgcttccggcctcacccttgctgacctggcagctgaagctggaggaaggggctttggaggggctgggctgtcagttcccagtttcgggggagcatgggcgggtaggcactggttggtccttgcgacctcatctggagagcagtggggttcactggtggtttagggggttcatcggggagagggtcccccacctggaggaggtaggaggcctcgccgtgaaggttgagggtcacctaggaggggaggggctctcacctgcgggcgccaaggcctcctctacgctcaggggctcttacctgcaacgcggagccttacctggactccggggctcacctggggcgcgggggtgggggcgggcgccgggggagggggcagtcctcgcgggctgggcaggggcgcggggcgacacgcagccctgacggcgcgggcctcacctcgcctgggcgcgcggggcccggtccgccggggtgggctggcctgggagtggggggcgctcctggcgggcgccgtcccccccgggcccgggttcgcaggcgcc

SEQ ID NO: 77 - DNA, 8748 bp, Homo sapiens
tgatcgaaaggcaaatatttatttttcaggaagagaaacaggagacctcgaggcttctggacttaggaggtccgggcagctggtccatggttgtccaggtagtgccgcagggctgtgggataatccgttatgacgccagtggctcccacgctgaaggctgcttcaaaatccgactcttcattaaggcaccaaaagaccacctgagcagggagggagggggcctgtagattctgaacaattttacatctggagagtggggacccacctcctcctctatggagactccccagcagcagtaggctggagctgattgttaaattctcaggaattttgcaaagtggttattaaacccagccattattaaaaattaaatcatagcctgggtgcagtggctcacgcctgtaatatcaacactttgggacgccgaggcaggagttgaggccaggtgtttaagatcgagtgagacctcatctctacaaaaaactttgtaaaaattaattagcccggtgtggtggtatgcgcctgtgctcccagctacttggaagactgaggtgaaagaattgcttgagcccaggactctaaggctgcagtgagctatggttgcaccactgtactccagcctgggcgatacaacaagacctcgtctcaaaaaaaaaaaaaaaattatatatactgacaattaaattatttatttatttatttatttattttttgagatggagtcttggtttgtcacccgggctggagtacagtggcatgaactcggctcactgcaagctctgcctcccgggttcacaccattctcctgtctcagcctcctgagtagctgggactacagatgtccgccaccacgcccagctaatttttctgtttttagtagagatggggtttcaccatgttagccaggatggtctcgatctcctaacctcgtgatccacccgcctcggcctcccaaagtgctgggattacaggtgtgagccaccgcgcccggccctaaataaattattaaaacaacaagtggccaggcgtagtggctcacgcctgtaatcccagcactttgggaggccgaggcaggcagatcaactaaggtcaggagttcgagaccagcctggccaacatggtgaaatcccatctctactaaaaacagaaaaattagctgggcgtggtggcgggcgactgtaatcccagctactcagaaggctgaggcaggagaatcgcttgaacccaggaggtggaggttgcagtgagctgagatcacgccattgcactctagcctgggcaacagagcaagactctgtctcaaaaaacaaaacaaaacaaaaaacaaaacccaaaacaaacaaaaatccagtaataaatattcaaagcatatctcttgctaatcagtttcctattactgtgttcttgaagtgattaagtctgttgaggctgcaagatggaaatactacatgatggggtgccaccatgcatctcttcccattctgcatttagtggcttcatgtcggcagcctgaaactggccaagatgggagtatttaaaccaggaaaattaatcctcaaatcagggctttcatttgttcctctctgagagctagttgttgaccacttaacagcaccaccctcccccaaacccccattccactgccacctgccccagctcctgcagctctgccccttccctgcccgttgagtgggcactgaggtaggcggagatgggaattttttatttaaaaatacagatgagacgaggtctctctgtattgccaacactggagtgcagtggtgtaatcacagcccactgtagccttgacctcctgggctcaagtgatcctcccacctcagcctcctaactagctgggactacaggcatgcactaccatgcccagttaatattttatttatttatttatttatttttgagacagtcttgctctgtcgcccaggctggagtgcagtggcgtgatctcggctcactatagcctccagctcctgggttcaagtgattctcgtgcttgagcctcccaagtagagctgggattacaggcatgcgccaccatacccggataatgtttacatttttagtagagatggggtttcacaatgttggccaggctggtctcgaactcctgaccttagttgatccgctggccttggcctcccaaagtgctgggattgcaggcatgagccactgcaccctgcctctgcatttttcttttctttcccttttcctttcctttttcctgtttccctccctctcctccctctccctgtctctggctctcacgctctttcctctctctcttttgagacagtctggctatctctcccaggctggagtgtggagtgcagtggcgtgattctgattatagctcactgcaccctcgaaaccccgtgctcaggtgatcctcccatctcagcctcctgagtggctgggactacaggtgtaaaccactgcgcttggctaatttttaaattttttgtagagacgagggtctcagtatgttgcccaggctggtcttaaactcctgggctcaagtgatcctcccaccttggcctctcaaagggctgggattacaggtgggagccgtgcccagcctctgcctatggcatttcttccctgtacccttgatgggaagctcccacccctagtaccatagtgcctggaacattctcaaggatcgtttactaattaaatgatctggtggaagccaatgctcaggggagaggggggtgggctgggcctggtttctcccatctctcatctttccccagccccctctcatcagggatcatgatacatcattgttgtcatcataatggctaacatttatcaagcccttaataagtactagttacatatccatatgttggcaatgtcaggttaagaaaatatgtgcgtggccaggcgtggtggctcacacctgtaatcccagcactttgggaggctgaggcaggtggatcacttgaggccaggagttcgagaccagcctggccaacatggtgcaaccccgtctctactaaaaacacaaaaattagccaagcatggtggcaggcacctgtagtcccagctactggggaggctgaagcaggagaatcgcttgaacccgggaggtggaggttgcagtgagccgagattgcaccactgcactccagcctgggtgacagagtgagactcttgacacacacacacacacacacacacacacacagaagaagaaaattgtgtgtgttcgtgtgtgtgtgtgtgtgtatccagagagttaaatataccattttcccattttagggacgaagaaactgaggtgaggtcacctgcccgagtgatgcagctagttggcagcagagtgggaccggaaccctgctgccaggtctgtgtgcggtggaagtggtggtcacggcctcacctgcacccctcgctcctccaagtgtcggatcagactcttcctcatgatcagcctgggggtggggtggggacgtgggaggtgatgatgagaggggacctgggagaagggcagcagtaggtctctatggggacacgccacccagccatcttgcccacctcaccatttcgaaaccacagccaataactggttcaggcaagagcaggaaaatgggaaataggtcctgcagagagaaggaagtgggggttagctcctagggtctcccctgtcccagaggtggggtgggctggtagtgcccccgccaactagggtagcgctgccctcccaccccccagaatcccccagaataacctttgtagttgccccagtgaacaattcacccattgttcagagagcctactctgaccaccacgcttcaagggtgtggccctccagtcaccattcaccagataaggaatctgggccttagagaacgaaagggacttgccagacccaaagcagagtggtggtggggctgggccagggcctcgcttggttccaaagctggacatccaggctgcaggccctcctggttgggcctggccagcttcttatttatctatttatcttattattaatttaaattaatttttttttttttgagacagagtcttgctctgtcgcccaggctggagtgccgtggtgcgatcacagctcactgcaagctccgcctcctgggttcacaccattctcctgcctcagcctcttgagtagctgggactacaggtgcccgccaccacgcctgctaattttttgtatttttagtagagacagggtttcaccctgttagccaggatggtctcgatctcctgactttgtgatccgcccgccttggcctcccaaagtgctgggattacaggcgtgagccaccgtgcccggccattaaaaaatttttgtagagacatgtctcactatgttgcccaggctggtcttgaactcctggactcaagcaatcctcccgcttcagcctcccaaaagtgccaggataataagcacgagccagccaagtgtggtggctcacacctgtaatcgcagcactttgaaagtctgaggtgggaggagaccagcgtggccaacatggcgaaacgccgtctctactaaaaatacaaaaattagccgggcgtggtggcagaccctgtagtcccagccacttgggaggctgaggcaggagaattgcttgaacccaggaggcggaggtttcagtgagccaagatcgcactactgcactccagcctgggccacagagtgagactccttctcaaaaacaaaaaacaatggccgggcgcggtggttcacgcctgtaatcccaacactttgggaggccgaggcgggtggatcacctgaggtccggagttcaagaccaccctgaccaacatggagaaaccctgtgtctactaaaaatacaaaattagccaggatggtggtgcatgcctgtaatgccagctacttgggaggctgaagcaggagaatcgcttgaatctgggaggcggaggttgcggtgagccaagatggcaccattgcactccagcctgggcaaaaagagcaaaactccgtctcaaaaacaaacaaacaaacaaaaaacccacaaaaaacctcgtgagccactgtgcccattggccagcttcttgagaccagacagcacttagtgggacgacccctaattatcccactccaggggtgactttagagacccttgacagtgtcctagggcaggctctggagtcagacccagggaaaacctaagctctggatttccagctgtgtgtccttgggcaaattacagaacctctctgggcctcagattctctagggtaccatgggagtcatgattcttatacctcctgggggtgctgcaaggtaaaagtcaacccaaaatatgttaaaacactttataaatcttgtataaggccgggcgcagtgggtcacgcctgtaatcccagcactttgggaggccgaggcaggcggatcatgaggtcagattaccatcctggctaatacggtgaaaccccatctctactaaaaacacaaaaaaattagccgggtgtggtggcgggcgcctgtagtcccagctactcgggaggctgaagcaggagaatggcgtgaaccagggaggcagagcttgcagtgagccgagatcacgccactgcactgcagcctgggcaacaggggaagactcctcaaaaaacacaaaaaaaatccggtataaaaaggtggtacacaaatatcattgatctctttgtagcaaggtattgtgggggctgagtgggacttccttctggacaacagaggggagcagagagctctgggactaccacagagaagctgtcagaaagcaaagggagaccgggcccaggggctcaggtatgtaatcccagcactttgggagaccaaggtgggaggctcgcttgagctgaggagttcaagagcagcctggtcaacatagtgagaccttgtctctacaaataatttaacaattagccaggtgcagtgttgcacgcctatactcccagctacttaggaggctgaggcaggaggatctcctgagcccaggaggtcgaggcgcagtgagtcatgatctggccactgcattccagcccgagcaagactgtctcaaaaaaaaaaaaaaaattgtaaagcaaagggagggactaggcttaagtgccagcgaagtatccaaattcctgatcctttccccagctgttactttgttaacccctgccttcctgcagaacactgacttggccttttcctgctgagggtctgagacagccgtgctataattaatgaacgaatgtctccccagccagactgtaagctcaccaaggacctctccccaccctcactggtctcatttacacattataactgcacctgggacagagtagacattcaataaaatatgctagatggcctgagatggataaattacctctctatcctaaaactccacatatgcacagaatttcagggtgttcacagttcccttagtattcatgaatgctgggtaagaaccactgtccttaaaagaccttgggggttatctctgaggggagctggggagctgggaagatctgggctccttctccacggagaccctaagcagtggggagtttttctgaggtccgccccccactggtacctgttgatgatgttgggcaggaagcagaagaagaacttctcagggattgggatgaagggcagcagccccaggtagtaggaaagcagcacccagaatcctcggcttattgtgaaggacaggggcatctcggggttctggggaggcaaggagaggcatgagaatctgtctgctctggggaagcagagaggaggcatgagctgcaggggagccgtggtgggcattccagaggccctactacctgcaggatccaagtcacatcttggggctgggtgtggtggctcacgcctgtaacctcagcagtttgggaggctgaggcaggtggatcacctgagatcaggagttcaagaccagcctggctaacatggtaaaaccccatctctactaaaaatacaaaaattagctgggcgtggtggcgtgcacctgtaatcccagctactcgggaggctgaagcatgagaatcgcttgaacccaggaggcagaggttgcagtgagccgaggtcgcaccaccgcactccagcctgggcgacagagagagactgtgtttcaaaaaagaaaaaaaacaaaagtcacatcttggctctgtgttcgaggcctgagttcacacccttttcattgccaccgccacgccactgggaactctcccagacccctctagctcgggtccccatgctgggtgggctccagctctggggaggaggggcccctggaggaggaagaggacgggggaggggtggggggactcacggcagccttgcatttcttcatgaccgagctcttctccgaggcccagatggtgatttcattacggtcatagcgtctcaccaagcctgctatctgggaggaggagaaggaggtgaagggagagccaggcctctctcacgcccccggtggccgccctagccctgcctgcagcaccacctcacggatgagctcttcgttcttccctttgatctctacgctcatgggtgtccttggaaacctctggaacaggtcctccagacgaaccatgcgccggtctgacccgtgagcaaagtggcctgggggtggtgtgggaaaaggggtcagagggaagccaaggcggaggtccaaggaaggcaggcatggcccaggcagggctcgaagcccttgctctcacctggagagaagtaaacctccagcttctccttgtagaggggcaggtcctggggaggacaggaaggatgtcactagaggcccgcattgggcatggtgactctcagggtgggggttggggtgtcagggcagggcccacctcgaagtccaggctgcccacatccctgtttaggcccgactggcggcacaggttctcatcatgtgacaccaccaccactctgtcccgtgtcagctgacagtcgagctccaggaggtccgagcgctgggccatggagctgtgggggtgaaggtcagcggggggcaggggcaggggactgggatgaggggcatggtggctgggaggtggccgggaatgtgagagcggagttcgtggcgggatgtgcaggccacctccagggggcgccagtcacccagctaggaagtgaatggcgtcccttgctgtgatgcagtccacgacctgcacaccctcacatggcagcctgggcaggggcagatacactcacttctccatggcctccatggtgttctccagcagctctccagatcctgtggggggcactggagtgggcctctggggcttggggtctaggggcctggcccaacctcatcacccacattccctctctgggctccatcctccctctggcctcacctccccagccagcccaggctgcgccagcatcttcttcctcgtccacaccctgccctgccacttcgctctccttctctcttggtccctgccccgtttctagcatgcccccttggacctacccctctgtgctgtccactttggcacctgttctcacccctacccggctcacctcctcggtgggcccccaggcggatgcggaaggtgggagccctgggcgtgtgcagcagatgaggccggcgcaggaagaagatggagagcatggcatagctgcccagggcagggagggcatagtacagcaaaaggctcatgaccgtactcccacagaagctcctgcagccacacgctcagccgtccgcgggactgtgctgcctgcctagccagtgtggg

SEQ ID NO: 78 - DNA, 9205 bp, Homo sapiens
tcagccatagacacatctctatatttatatattagacgggtcagggaggtggcaggggcgccgggctctccacgccccccagctccacttctgctcaccacacacagaagcagcgagggcacgcgaagtgacagctttgacagggaggggattcggcccggcctggctcctcagggatgctagcccttgagactaaggaatgttccttcagggaaactagggtggggtttgaatgagatgaggggggcaggcatggccctgagtccctactcagcgccccccaccctccacctctgcccttcagcaggttggggcagccagaacccttccattccagaactgccagagactgggacgctggggaaggtaagggcgcagcagcagcagcgggagattgaactggggccacctgaggtcccgaggccccgtggggagggcgggtggggaggagaaggccttggcctgcctgaagctggaggcctcagcaaaggagagaggtggccaggcccatgctccaccccggcctgggctgccaaggtccgggctgggcacagtgtccattttctaacagtctggcgggagaggggcaggcaggaggcaggtcctaaagagagaagcaggcagaagaggagtcgttagcaccccccgggcagacccactggagccctgacctcaacatctctcatttcaccctcacagctggataggctgggtctcagtttccttatctgtaaatggagataataatagtacctagcttgaggtactgctgtaagattaaaggaattaatacatgtaaacctcttagaacaatgcttagggctttatgctttcattattagaactgtctcggccgggcacagtggctcacgcctataatcccagcactttgagaagctgaggtggtggatcgcttgagcccaggagtttgagactggcctgggcaacatagcaagaccccagctccacaaaaaaaaaaaaaaaaaattagccggttgcaatggctcgtccagctagctgggaggatcccttgcacccaggagttttgaggctgcagtgagctatgattgcaccactgcattccagcctgggtgacagagcgagacactgtctcaaaaaaacaaaaccaaaaaaaaagataaatagattgactccggaaactgaggcgccgagaggtgaggtgccttgcccaatatcacacagcacttactaagtggcacagctggagtttgagcccaggtgcgcatgccttctttctatcaggccacacctggctgaagacaggaagagaccggaggaggcaaggaggcagcgtgggtgggggcaggccagtggggtccccacagctatgtgaactgctgatctggcagcaggtgtgaggaggcctggcaatctgggtcaggctgggcgctgctgggcccctcccaaagcaatcatggccccacctgcttctgccacacccagagctgaagcttggctcaggtcctcacctgggtgacagaggccctcagtgacctcttgcctctttgccagttctgttcctagaaggagattagaatggcttgtggggctggaggatgcaaggtgttgacaggcagagacatttggggctggaggactcggtgggccaccagtctgggcagccttgggcatttttttttttttttttgagatggagtcttgctctgtagtccaggctggagtgcagtggtgcgatctcggctcactgcaacctctgcctcctgggttcaagcaattctcctgcctcagcctcctgagtagctgggattataggcatgtgccaccacacccagctcatttttgtattctttacagtagagaccgggtttcaccatgttggccaggctggtctcaactcttgaccttgtgatccacccacctcggcctcccaaagtgctgggattacaggcatgagccactgtgcccagcccttttttttttttttttgagagagtctcactgttgcccaggctggagtacagtggtgcaacctccgcctcccaggttcaagcagtcctcccaccacagcctcctgagtagctgggactagaagcgcatgcctacgtgcccggctaatttttgtatttttagtagagacagggtttcaccacgttggccaggcaggctggtctcggactcctgacctcaggtgatccacttgcctcagcctcccaaagtgctgggattaccagagtgacccactgtgcccggctaatttttgtatttttagtatagatgggatttcaccatgcaggccaggctggtctcaaactcctgaccctcaggtgatccactcctctcagtctcagtctcccaaagtgctgggattccaggcatgagccaccacacccagccccctgggcacttctgttgtcaccagacacattgaccatgggtgtggggtaagcttgctgctgtatggaggcatgtacagatagatatagatatagatatacagatatagatatttagtatcagggtgtccatgtgtgggccatggagacactcaccaggccccagggtgcagagatgtctgtctgggctagggggcctccagcactccgggctggaagcgtgctgtctcctggaagatgagctccttcagccgctccttaggtaggtcatccagctccatggcgaaggtgaagggctcctcggccactggctggggtggtagagacagcaaggctcaggcctggcatgggggatgcctacgtgcccccctgctcccctgcccccagccccactgctgctggggactggcccacctcatccgtcgggtcatagtactgctccaggtaggggtgagccagcgcttcctccactgtgatccgtttattggggttaaaggttaacatccggtccagcaggtcaagggctatggaagggcaggagtcaggggtcacagggaagactggaggagctccgagaagcattgctttgcctgtctcctccagcggctgctgggctcacacaccctccacgacacccaaggtttatcccacacccaccctcatgtctctcgaacctttggagtctgacttggggaaaagcttggcccaagccaccttggtcttggagggcagagactgtaggtagtttcgggccttcatgttgatgatacaattcaggtcctcctgggatggggagcccaggatgcctgtggataaggaggtgacttggtaaatgatcacctctttctttctgggaacagaataggcaacaaggcaagaacaagaccccccagcccagcaacccatgccaatccctcagtcacctcctagtcattagcatggtggtgcagagcaagggggctgggttcaggcagaccgaggctcaaatcctaggtctggtgcctcctcaggtgtgggacttagccttgcttttcccatctatccaatggggataatatctatacctcattgagataccatgagatgctggaggcaccccacacgtggtggtatccctgacttggactctcgagaaatctcacctcggaaaagctaatcatccccaactcagccagccgggcctccctcacccagaatgtggttgagctgatccaggtagtgcttgccagggaagatgggccggttagagagcatctcagccagaatgcagcccacagaccagatgtcgatggacttggtatagccctgggggagaggaggaagtggtgagctcctgggccagcctcaacagggtcctgttgtctgcgccaggccaccacctccaagttagatccaacaccaggcagaaggcagaggcctggagggctcaatgctcagcttccttgcagagcccaaggcccagagggtagaattcctgtgtcatgggggtcagtgtctggctcagaggtagctccagggcttcctgggaactggtccgttcctttcaggagtgggcagcccctcctaccttggagttcagcatgatctctggggcccggtaccagcgcgtagccacatactccgtcaggaagccggtgtggtcatgctcaggatcggcaatccgggccaggccgaaatcacaaatctggaatcagacctagctgctaagctcggcgctcaaggcctctgcagcctaagcagtcacgcccccttgtctttgcctccactgttccctttgcttgcaatgttctcctgcccaaggcttcttctactggtcactggaagccccagaccctgggggaggaggggacaggtgcccaaccctctgaccttaaggtcgcaggtggtgttgatgagcaggttggagggctttagatctcggtggagcacgttggcggagtggatgtacttgaggccccgcaggatctggtagaggaagtagcagatatggtcattgctcagctgctggcttttcagcaacttgtacaggtcagtctccatcaggtcctgcacaatgtagctgaggatggttccgcagacccccccaggcagggggcagtgggaggcacttggttaaggaaaacaggctctgaaggcgaggctgcacacctcctccagccagggcccctgggactcaatagatctgccaacctgcaccaccagctggggaagctgctgccattacccagcggcagggctctgagcctctgttgcatcacagttgctgatcctgagcaaggggcttcatttctgaggcctcagtttccctaccggggaaacggggataataataaactgtgggaggcaggagaacttcacagttaagagcagcaacttgggccaggagtggtggctcacacctgtaatcccagcactttgggaggctgaggcgggaggactgcttgaggccaggagtttgagaccaccagcctgggcaacatggcaaaaccctgtctctactaaaaatagcaaaattaactgggcacggcggcatgtgcctgtaatcccagctactcaggaggctgcagcacgagaatcacttgaacccaggaggcagatgttgcagtgagccaagattgtgtcactgcactgcagcccggatgacagagtgagactctgtctcaaaaataaataaattaaaaaaaaaaaaaaacctacaaaaagagcagcaactctggagttaacccatggatgtctgaaatctcctctctactactcactggctttaggatctcaacctgtctgtgcctcaactttctcatctggtatgtaggggaaataatgtttttttgtttgtttgtttgttttctttttgtggagatgggctcttgctctgttgcccaggcaggtcttgaactcatgggttcaagtgttccttccacctcggcctcccaaagtgctggaaattacaggtgcaagccatgaaataatggttcttttgagggtggttgtgaagactagatgagatggcgcatgtaaagctgtcagcccagtgcttggcaagttgtgagtgctaggcaaacatgaactattattactaatatgaatgcctgagtcacatggctgttgagggagttaaatgagataatgtatgaacaccatctggcatgcaataaatgtttgcttaaaaataaatgcctgccttatgggaatggtttgtgcaagaaaaatgaggagacactcccaacagcacactcccactcaaaggagagtgcttggccatacctcagaagatggaggagtaaaatgtctttttctatttgaagatacaaaaaagcttatgcgtaaataaataaataaatccacaaatgctgtttggcttgtctctagaaaaataagtcagggctgtcttttagaatctgccttgagaccaggcatggtggctcatgcctgtaatcccagctcttcaggaggccaaggtgggttgatgacctgaggtcaggagtttgacgccagcctggtgaacagggcgaaaccccgcatctactgaaaatacaaaaattagccgggcgtggtggcaggcgcctgtagtcccagctacttggaaggctgaggcaggagaatagcttgaacctgggaggtggaggttgccgtgagctgagattgagccactgcactctagcctgggcaacagagggagactccatctaaaaacaaacaaacaaaaaacaaagaaaacaagaatcagccttgaaagggtcttcagagaatatgtggaccagccctgctgttttagggctggggaggcccagcgagacgcagtgacttgcttcagatcacacagcgagctgggggtgagcacggagatttcctgtccacagtttgtggtgggggttgcagacacctcagtacaaatccccactcttgggtggagggctgggactgagagtgggtgggtggggcagggaagaagtgacaggtgtcataagttgctaaggagagccagacaggaagtggacagcaaactaggaaagcagtattgggggaggacagccaaggctaggctgtccctccctgggcaaggtgcaagtccacaggtgattagggtgtggctctgagtgagaagtcctaagaagaaggacaagttcccatctgggggaggagaggaggagacagcaacagaaacacttgattttaggttttctgagccttagcttcctcatctttttttttttttttttttttgacagggtcacgctctgtcccccaggctagagtgcagtagcacaatcatagctcactgcagcctcgaactcctaagctcaagccatcctcctgcctcagcctcccaagtagctgggactatagtcgtgtaccaccaaacctggataatttttaaattttttgtagaggtggggtctcactatgctgcccaggctggtcttgaactcctggcctccagtgatcctctggtcttagcctcccaaagtgttgggactacagatgtgagccattgcactccacccctcatctttgaaatgaagctgaaaagcccatctcatagggtagttgggaggtgtaatagaaaaaaaaaagcattgggcatgtatagtacctgacacacagcaggccctcaagaaaggcagttttttgtttttgtttagttttgagacagagtctcgctctgtcacccaggctggagtgcagtggcacgatcttggctcactgcaacctccagctcctgggttcaagcgattctcctacctctgcctcccaagtagctgggattacaggcttgcaccaccatgccccgctaatttttttgtatttttagtagagatggggtttaaccatgttggccaggctggtctccaactactgacctcaggtaatctcccacctcagcctcccaaagtgctgggattacaggcgtgagccaccacgcccagctgacagttttctttctccctgtctcccttccggtctgggcaaggaggaaagagaggaaagaatcatccattccttagcaagaagtgactgtgggcagaggccaggtcatgtctcagaactgccgacgtcagaagacaccactcccatagagaccatcctgcctagcccttccccctggggcacagagcagagaacccacttgctcgaggccatactgcctgggccgctgcaggcctgggttcatcagaggtctccaagtcctgttacactgtggcttcccctctgcaggaaagtttattttactgggtttgttttggagggtggtgggtaagatggaaacagaaaccaagcaacgggtccccagcccagctgcgaggccgtgcctgaccagccgactggccaaggtgaaggatacacatctctcatggcttccagggtggacgcccgcagaatgtctcggatgccgatgacattctcatggcggaagcgcagcaggatctggatctcccggagcgtgcgctggcagtaggtctgatgttcgaaggggctgatcttcttgatggccacgcgagtcttgcgcacgtggtcataggccgagctgaggggaccggagagaggctgctgctgtggccttacaaagggggagtccgggcctggtggccccacccaggccttggcagggaggggagagagcaggagctggctctggtcaaatcataaacaatgctggttccttcctgctgtggaggcctgggatctccagagagaaagctggggaccagccaggcggcccttcggtgactttacaaacagaggaagagactgaccgctcactgacttcccctctcctcaatccccttccattctactggccctgaacccttcgcccccattcccaggaaaggctccttaacccaagacaggtccgggggtgcagatgctggggacacaccatggggcaaatactgggaaggtggcagccaggggaggggcaggagagaatggacagggcaggggagggtcccagggtgagggatccgggcagcggggctgtcccagagggatagaggcccagagcacacggtggggccgggggcactcacagacccctcccaaaacatgcaggtggcactcctggccgcctcatctctctctgggcccctggggtggtggggccaaagccctgccccaccctgatctcggctcttctcccccaggctccctggcactgcctcacagggggaatccaagacaccctttcccccaaaacgggccctccactgcctcttcactaaggatgtcgcctccccgagagtactcatcctctgggcctcgccccgtgtcactagggtccccgcgggcccccacatgcactcggatgcccctcccatcattacagaagggtggactcaaagcctccaagcctgctcccctgaggacgtaggcagcgccccctcccccagaaagcactcaggggccccctccctgggacgctcccgatcatcccgagtctcctgcctcctcgggacgctccgcgtctccacgtcccggaaagcgctcggcgcctcctcctcctctcccgcgaagccccctcccctgagggcaccccctcccccggaacgccccctcacctgaccatgccgtacgcgccctcgccgatgtactgcaactgcgtgtagcgcgggcccacgtcgaacggctgccccttcaccatctccacctcccccgggacccccgggccgaccccctcggttctacggggctccccgcccccgcccccctgagccgccgccgccgccatctccactcctcccctcccaccgccctcctccccacggcggccccgcccgaggccccgccccttcccgcctgcctgtcacccgcagggccgcgcgcgccag

SEQ ID NO: 79 - DNA, 5472 bp, Homo sapiens
cattgtcttgacaagagcatcttcagcgggcgagtccccggctcctccagctccttcctcctcttcctcctcctcctccacctccggcttttgggggatcactgtcctctctcggcagcaggtgaggctgggcctgggaggcgcgggtgggccggggcgagggccacctgtggggcggcgcgcgcgtgggagccgcgggctgcgggggcgcgcggctgtcaccgcgacccagccagcgccggggccaggtagcgggcgcagcagcccgtggggggacgctgcttggagtgggggccgccggggccccagagcgctctgcggaggcgagggctagggaccaccgcggccaagatggaggtgggtggccgggggtcagcacagtgtcgagggcccgactccccacggaattgagtctcggggagggtggggacgagggcagggtggggtgagcggggcagctgccctgggcttggagacaggaaggggttgagagcaaaacaagaaaagaccaagttcccctttccgtggtttccgggcctggtacctgtggtgggggaggaggcagggtggggcgatggcttcctgtcccccacctctggtccggggctcccctctctccagatacaggctgctcctcaagactggggctcttcacatacgctcctcaccgctctttgggcaggccgacctagcagcctcttcgggagtcctggggtggccgggggtgctggagcccccagtgagtaggcgaggctgaggctaggggcagaggctctgggcatggcaccctccaagcggcagcacaggccccttccctgagcaggaaggtgatgcggtggcacaaggtcgcccctggagttccttgctccccacccagacactgggggaaaccatcctacctggacctcagagcagtcggagtggcctctcccttcctgtgtgcagtttacatgggggtggagatggctcttaagggcacctgcttttctgagcggaggcgagaggcagaggtatggggaggaggagatacctggacctgagccagagacctgctggggaagctatcctgccgcctcactcccctcaggcagcccccacgccacttcctcctgtgtccagccccatgccagcaggcgagggaggccagctcctgtccctgcctttaggaagcgctgtgtgggtgtgagggaggtgggctctggacacggtaactaagagagaacccaccctcggagccatctgggctgatgacgcctgagtctgaaccattaggaaggacgggctctgcatccatcagccagtcagtcaacaaacatgcagtggggcaacaccacgccaggctctgttgcagaggctgagggtacagattgagagggtggctcagagtggcctggggccagggagaagggggcttgcaggttagagggaaggagaggctggggaaggcaagcaggcatcagccacagagggaagaatagggagcccctggagatgatgctgggaccttaaaagccagactgaggggtgtcctgggggaggtggggaccactggaagatcagagttgacctgaagggagaaatgctcttatgctgtgtgcccccagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaaggtgagcccctggggccctggggggagcagctcctccaccggacccatggctctgtgcaggtcctgattaggtgacggtcaccaggccttccagggcctgtgttgccatctggaaaactgagctgggccccatgagccttacacttcctccagctcctctgtgctgtggctgtgtggaaactgacgctcagaaggagccaacacaagatgggtcacaccagtgaccaggactacagacagtcctgcagacccatgatcagccctcctgagcctcagcctggggctttctccccatggaaacacagagggggttgggatggggtctgggggccctggcagcgttctcagggttgggagggactctggctctgggcctgtctgaggacctagcaactctgtcccccagctcgcaggcagggatgatgcaagaggtgctctcccccacccgcagccctgccctcccctggagcctgctgccccctccgctggctggctgctgccccgcacccccagcacactcctgtgctctttggggggtaagacaggaaggggagatgggccccaagttgttaccttaaaagggctgatggaagcaaagagaagaggaagtggttgtcggggtgagagctgggcccgcgccccacatggctgtcacacaggaagccctgctgaagcagctgtccccggaagaagccatttccaaacctctgctcctgcctggggccagttgggacaggctccctggcccctctccttttgggaggacccacccctgcagccccaccactcacactcgctctctggggagctgcctccacccccccagcccccatacacctgtcctggctccagggccagttgtgcccatggaagcctcactcggggaagctggggtgggggtgccaaccctaagggcagagacagactgagacagagaccggcgggaactctgccagggtcttgcacggcccccaacctctgccatgcgtggccagccctcctggggtttgcccaggccattttgggactggaacaagagaagaacaacccgcccccgtccccaccccaggccctggtccagctcccagggacaccacagctttcctctctgggcctctctgaaggaggtgtggggaggttggattgggtttgggaggcaaaagcacctccaaggccctgctgtgcctttagactggacgtgtggacaagaatgcgcccacggtctgtggccacacagcccctgtgctagacatcgcctggtgcccgcacaatgacaacgtcattgccagtggctccgaggactgcacagtcatggtgagtggtggtggggacccaggggctgggagaggggctctaggatgggatctgacatttggagtcctgaagactcactggcccctcctctgcaggtgtgggagatcccagatgggggcctgatgctgcccctgcgggagcccgtcgtcaccctggagggccacaccaagcgtgtgggcattgtggcctggcacaccacagcccagaacgtgctgctcagtgcaggtgctgcgggaggaggggcttgggggtggctcgtggcctgcagtggatgagggcaggaggctcatggcttctgacactgtggggaacgtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgtgagtcgccatctaccctgacctttgaccctacagcctttatccttcttatccaccatcagccaggcccttggatgctgccctccctcgcctccacctgggactggccccgtagggtatgtacgggtgcctgacctaccacctccctttccttgcaggagaaggaccgtccccacgaggggacccggcccgtgcgtgcagtgttcgtgtcggaggggaagatcctgaccacgggcttcagccgcatgagtgagcggcaggtggcgctgtgggacacagtgagtgctggggcaggaagccgagggcccccaggctgggaaccaagactggaggtttcgtccctgctctgccactcacctggcaggatggccatgggcctcagtttacccaggcgtgagatggttgttcccactggttggtcgggagggccctcacaggtcactgcccagggaagaccaccatcccagggcctgggatgttacctctcacctgtgtctacagaagcacctggaggagccgctgtccctgcaggagctggacaccagcagcggtgtcctgctgcccttctttgaccctgacaccaacatcgtctacctctgtggcaaggtggcctcgtcgggcggggtgggggtgggaggtgggcaggatgggcctggagagggccagggcagtgggcatccgctggtattgaccctccctccacacctgccacctacagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggtgactgacccccggccctgaccgcagcatgctccttgggcagtgggcagtcccaagcccacccaaccagactgtgggccccgctcaccttccccttcccacaggttctacaagctgcacgagcggaggtgtgagcccattgccatgacagtgcctcgaaaggtgatgctcccccgccccaccctgggctccaggctgggcactgactttgcggtcttgtggggggtgtcctggcataagcgctttcctcactatccctggccttgcccacagtcggacctgttccaggaggacctgtacccacccaccgcagggcccgaccctgccctcacggctgaggagtggctggggggtcgggatgctgggcccctcctcatctccctcaaggatggctacgtacccccaaagagccgggagctgagggtcaaccggggcctggacaccgggcgcaggagggcagcaccagaggccagtggcactcccagctcggtgagagggctgggaagccagggaataaaactgggagggtggggtggggctggtgtttggggcacctcaaactcacaacattgggaatctttgtgggtccgggaatggtaatcctgaggcctcagaacacaggtttcagattgataggcctgcaggtctccaggcagcaaccagctgagcgactaaagggcccaaggccagggctctagggatggggctcagcagaggctggggtaaggggagccagggaggagctgggcctaatgcagcaccgggtccccaggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatggcagagaaaaaaatcataataaaatggctttattttctggta

SEQ ID NO: 80 - DNA, 35 bp, Homo sapiens
acccacaatgggctcacaggtacctccagggccct

What is claimed:

1. A method for diagnosing a predisposition to an autism spectrum disorder in a human individual or a human fetus, the method comprising:

(a) detecting in nucleic acids from said human individual or human fetus the presence of a microdeletion of about 500 kb that is flanked by a microduplication of about 100kb to about 147 kb on the chromosome region 16p11.2 between positions 29.5Mb and 30.1 Mb; and correlating the presence of said microdeletion of about 500 kb that is flanked by a microduplication of about 100kb to about 147 kb on the chromosome region 16p11.2 between positions 29.5Mb and 30.1 Mb with a predisposition to an autism spectrum disorder in said human individual or human fetus.

2. The method of claim 1, wherein the microdeletion or microduplication comprises at least one gene selected from the group consisting of: BolA-like protein 2 (BOLA2), GIY-YIG domain containing 1 isoform 1 and isoform 2 protein (GIYD1/2), sulfotransferase, cytosolic, 1A, phenol-preferring, member 3 or 4 protein (SULT1A3/4), sialophorin (SPN), quinolinate phosphoribosyltransferase (QPRT), human chromosome 16 open reading frame 54 (c16orf54), kinesin family member 22 (KIF22), MYC-associated zinc finger protein (MAZ), proline-rich transmembrane protein 2 (PRRT2), human chromosome 16 open reading frame 53 (c16orf53), major vault protein (MVP), CDP-diacylglycerol-inositol 3-phosphatidyltransferase (CDIPT), seizure related 6 homolog (mouse)-like 2 protein (SEZ6L2), aspartate beta-hydroxylase domain containing protein 1 (ASPHD1), potassium channel tetramerisation domain containing protein 13 (KCTD13), transmembrane protein 219 (LOC124446), HIRA interacting protein 3 (HIRIP3), coiled-coil domain containing 95 protein (CCDC95), double C2-like domains protein, alpha (DOC2A), family with sequence similarity 57 protein member B (FAM57B), aldolase A or fructose-bisphosphate (ALDOA), protein phosphatase 4, catalytic subunit (PPP4C), yippee-like 3 protein (YPEL3), glycerophosphodiester phosphodiesterase domain containing protein 3 (GDPD3), mitogen-activated protein kinase 3 (MAPK3), coronin 1A (CORO1A), TAO kinase 2 (TAO K2), and T-box transcription factor (TBX6).

3. The method of claim 1, wherein the microdeletion or microduplication comprises SPN, MAZ, TAO K2, and TBX6 genes.

4. The method of claim 1, wherein the detection is performed using an oligonucleotide-based array comparative genomic hybridization (oligonucleotide-based CGH).

5. The method of claim 1, wherein the detection is performed using a bacterial artificial chromosome-based array comparative genomic hybridization (BAC-based CGH).

6. The method of claim 1, wherein the detection is performed using a fluorescence in situ hybridization (FISH).

7. The method of claim 1, wherein the detection is performed using a multiplex ligation-dependent probe amplification (MLPA).

\* \* \* \* \*